United States Patent 11,564,997 (MATERIALS AND METHODS FOR TREATMENT OF FRIEDREICH ATAXIA AND OTHER RELATED DISORDERS) - sequence listing, part 3

SEQ ID NO: 24616 - DNA, 20 bp, Artificial Sequence
  Description of Artificial Sequence: Synthetic oligonucleotide
  Target: FXN; (-) strand; PAM type: YTN; PAM sequence: CTT
accctgggtggcccaaagtt

SEQ ID NO: 24617 - DNA, 20 bp, Artificial Sequence
  Description of Artificial Sequence: Synthetic oligonucleotide
  Target: FXN; (-) strand; PAM type: YTN; PAM sequence: TTA
tcttaccctgggtggcccaa

SEQ ID NO: 24618 - DNA, 20 bp, Artificial Sequence
  Description of Artificial Sequence: Synthetic oligonucleotide
  Target: FXN; (-) strand; PAM type: YTN; PAM sequence: TTT
atcttaccctgggtggccca

SEQ ID NO: 24619 - DNA, 20 bp, Artificial Sequence
  Description of Artificial Sequence: Synthetic oligonucleotide
  Target: FXN; (-) strand; PAM type: YTN; PAM sequence: TTT
tatcttaccctgggtggccc

SEQ ID NO: 24620 - DNA, 20 bp, Artificial Sequence
  Description of Artificial Sequence: Synthetic oligonucleotide
  Target: FXN; (-) strand; PAM type: YTN; PAM sequence: CTA
tgacgtggaaggtgttttat

SEQ ID NO: 24621 - DNA, 20 bp, Artificial Sequence
  Description of Artificial Sequence: Synthetic oligonucleotide
  Target: FXN; (-) strand; PAM type: YTN; PAM sequence: CTA
atgggagaggcagggaagga

SEQ ID NO: 24622 - DNA, 20 bp, Artificial Sequence
  Description of Artificial Sequence: Synthetic oligonucleotide
  Target: FXN; (-) strand; PAM type: YTN; PAM sequence: TTC
taatgggagaggcagggaag

SEQ ID NO: 24623 - DNA, 20 bp, Artificial Sequence
  Description of Artificial Sequence: Synthetic oligonucleotide
  Target: FXN; (-) strand; PAM type: YTN; PAM sequence: CTC
aggaagaaaaccaggttcta

SEQ ID NO: 24624 - DNA, 20 bp, Artificial Sequence
  Description of Artificial Sequence: Synthetic oligonucleotide
  Target: FXN; (-) strand; PAM type: YTN; PAM sequence: CTG
ctcaggaagaaaaccaggtt

SEQ ID NO: 24625 - DNA, 20 bp, Artificial Sequence
  Description of Artificial Sequence: Synthetic oligonucleotide
  Target: FXN; (-) strand; PAM type: YTN; PAM sequence: TTG
ctgctcaggaagaaaaccag

SEQ ID NO: 24626 - DNA, 20 bp, Artificial Sequence
  Description of Artificial Sequence: Synthetic oligonucleotide
  Target: FXN; (-) strand; PAM type: YTN; PAM sequence: TTG
ttgctgctcaggaagaaaac

SEQ ID NO: 24627 - DNA, 20 bp, Artificial Sequence
  Description of Artificial Sequence: Synthetic oligonucleotide
  Target: FXN; (-) strand; PAM type: YTN; PAM sequence: CTA
agattgttgctgctcaggaa

SEQ ID NO: 24628 - DNA, 20 bp, Artificial Sequence
  Description of Artificial Sequence: Synthetic oligonucleotide
  Target: FXN; (-) strand; PAM type: YTN; PAM sequence: CTC
agtcacatggaaagatgcct

SEQ ID NO: 24629 - DNA, 20 bp, Artificial Sequence
  Description of Artificial Sequence: Synthetic oligonucleotide
  Target: FXN; (-) strand; PAM type: YTN; PAM sequence: TTA
aaaataatgtggtggatact

SEQ ID NO: 24630 - DNA, 20 bp, Artificial Sequence
  Description of Artificial Sequence: Synthetic oligonucleotide
  Target: FXN; (-) strand; PAM type: YTN; PAM sequence: TTC
attaaaaataatgtggtgga

SEQ ID NO: 24631 - DNA, 20 bp, Artificial Sequence
  Description of Artificial Sequence: Synthetic oligonucleotide
  Target: FXN; (-) strand; PAM type: YTN; PAM sequence: TTT
cattaaaaataatgtggtgg

SEQ ID NO: 24632 - DNA, 20 bp, Artificial Sequence
  Description of Artificial Sequence: Synthetic oligonucleotide
  Target: FXN; (-) strand; PAM type: YTN; PAM sequence: CTA
tttcattaaaaataatgtgg

SEQ ID NO: 24633 - DNA, 20 bp, Artificial Sequence
  Description of Artificial Sequence: Synthetic oligonucleotide
  Target: FXN; (-) strand; PAM type: YTN; PAM sequence: CTA
atactatttcattaaaaata

SEQ ID NO: 24634 - DNA, 20 bp, Artificial Sequence
  Description of Artificial Sequence: Synthetic oligonucleotide
  Target: FXN; (-) strand; PAM type: YTN; PAM sequence: TTA
tgtcacatccatgcaatcta

SEQ ID NO: 24635 - DNA, 20 bp, Artificial Sequence
  Description of Artificial Sequence: Synthetic oligonucleotide
  Target: FXN; (-) strand; PAM type: YTN; PAM sequence: TTA
aatggattatgtcacatcca

SEQ ID NO: 24636 - DNA, 20 bp, Artificial Sequence
  Description of Artificial Sequence: Synthetic oligonucleotide
  Target: FXN; (-) strand; PAM type: YTN; PAM sequence: CTG
aatgtccaacagtaggggat

SEQ ID NO: 24637 - DNA, 20 bp, Artificial Sequence
  Description of Artificial Sequence: Synthetic oligonucleotide
  Target: FXN; (-) strand; PAM type: YTN; PAM sequence: CTG
gaaacaacctgaatgtccaa

SEQ ID NO: 24638 - DNA, 20 bp, Artificial Sequence
  Description of Artificial Sequence: Synthetic oligonucleotide
  Target: FXN; (-) strand; PAM type: YTN; PAM sequence: CTC
tggaaacaacctgaatgtcc

SEQ ID NO: 24639 - DNA, 20 bp, Artificial Sequence
  Description of Artificial Sequence: Synthetic oligonucleotide
  Target: FXN; (-) strand; PAM type: YTN; PAM sequence: TTG
aaactctggaaacaacctga

SEQ ID NO: 24640 - DNA, 20 bp, Artificial Sequence
  Description of Artificial Sequence: Synthetic oligonucleotide
  Target: FXN; (-) strand; PAM type: YTN; PAM sequence: TTA
aataaaataatattgaaact

SEQ ID NO: 24641 - DNA, 20 bp, Artificial Sequence
  Description of Artificial Sequence: Synthetic oligonucleotide
  Target: FXN; (-) strand; PAM type: YTN; PAM sequence: TTA
gggtattaaataaaataata

SEQ ID NO: 24642 - DNA, 20 bp, Artificial Sequence
  Description of Artificial Sequence: Synthetic oligonucleotide
  Target: FXN; (-) strand; PAM type: YTN; PAM sequence: CTA
ttagggtattaaataaaata

SEQ ID NO: 24643 - DNA, 20 bp, Artificial Sequence
  Description of Artificial Sequence: Synthetic oligonucleotide
  Target: FXN; (-) strand; PAM type: YTN; PAM sequence: CTA
actattagggtattaaataa

SEQ ID NO: 24644 - DNA, 20 bp, Artificial Sequence
  Description of Artificial Sequence: Synthetic oligonucleotide
  Target: FXN; (-) strand; PAM type: YTN; PAM sequence: CTC
taactattagggtattaaat

SEQ ID NO: 24645 - DNA, 20 bp, Artificial Sequence
  Description of Artificial Sequence: Synthetic oligonucleotide
  Target: FXN; (-) strand; PAM type: YTN; PAM sequence: CTG
ctctaactattagggtatta

SEQ ID NO: 24646 - DNA, 20 bp, Artificial Sequence
  Description of Artificial Sequence: Synthetic oligonucleotide
  Target: FXN; (-) strand; PAM type: YTN; PAM sequence: TTG
tgatagcagcatggcctgct

SEQ ID NO: 24647 - DNA, 20 bp, Artificial Sequence
  Description of Artificial Sequence: Synthetic oligonucleotide
  Target: FXN; (-) strand; PAM type: YTN; PAM sequence: TTT
gtgatagcagcatggcctgc

SEQ ID NO: 24648 - DNA, 20 bp, Artificial Sequence
  Description of Artificial Sequence: Synthetic oligonucleotide
  Target: FXN; (-) strand; PAM type: YTN; PAM sequence: CTA
tttgtgatagcagcatggcc

SEQ ID NO: 24649 - DNA, 20 bp, Artificial Sequence
  Description of Artificial Sequence: Synthetic oligonucleotide
  Target: FXN; (-) strand; PAM type: YTN; PAM sequence: TTG
ggtctatttgtgatagcagc

SEQ ID NO: 24650 - DNA, 20 bp, Artificial Sequence
  Description of Artificial Sequence: Synthetic oligonucleotide
  Target: FXN; (-) strand; PAM type: YTN; PAM sequence: TTT
gggtctatttgtgatagcag

SEQ ID NO: 24651 - DNA, 20 bp, Artificial Sequence
  Description of Artificial Sequence: Synthetic oligonucleotide
  Target: FXN; (-) strand; PAM type: YTN; PAM sequence: TTA
aatatttgggtctatttgtg

SEQ ID NO: 24652 - DNA, 20 bp, Artificial Sequence
  Description of Artificial Sequence: Synthetic oligonucleotide
  Target: FXN; (-) strand; PAM type: YTN; PAM sequence: CTA
ttaaatatttgggtctattt

SEQ ID NO: 24653 - DNA, 20 bp, Artificial Sequence
  Description of Artificial Sequence: Synthetic oligonucleotide
  Target: FXN; (-) strand; PAM type: YTN; PAM sequence: TTG
agctattaaatatttgggtc

SEQ ID NO: 24654 - DNA, 20 bp, Artificial Sequence
  Description of Artificial Sequence: Synthetic oligonucleotide
  Target: FXN; (-) strand; PAM type: YTN; PAM sequence: TTT
gagctattaaatatttgggt

SEQ ID NO: 24655 - DNA, 20 bp, Artificial Sequence
  Description of Artificial Sequence: Synthetic oligonucleotide
  Target: FXN; (-) strand; PAM type: YTN; PAM sequence: TTG
gtttgagctattaaatattt

SEQ ID NO: 24656 - DNA, 20 bp, Artificial Sequence
  Description of Artificial Sequence: Synthetic oligonucleotide
  Target: FXN; (-) strand; PAM type: YTN; PAM sequence: TTA
ttggtttgagctattaaata

SEQ ID NO: 24657 - DNA, 20 bp, Artificial Sequence
  Description of Artificial Sequence: Synthetic oligonucleotide
  Target: FXN; (-) strand; PAM type: YTN; PAM sequence: CTG
cccagagaggaggacacaaa

SEQ ID NO: 24658 - DNA, 20 bp, Artificial Sequence
  Description of Artificial Sequence: Synthetic oligonucleotide
  Target: FXN; (-) strand; PAM type: YTN; PAM sequence: CTG
tactgcccagagaggaggac

SEQ ID NO: 24659 - DNA, 20 bp, Artificial Sequence
  Description of Artificial Sequence: Synthetic oligonucleotide
  Target: FXN; (-) strand; PAM type: YTN; PAM sequence: TTC
aggaggtatgccaaccctgt

SEQ ID NO: 24660 - DNA, 20 bp, Artificial Sequence
  Description of Artificial Sequence: Synthetic oligonucleotide
  Target: FXN; (-) strand; PAM type: YTN; PAM sequence: CTT
caggaggtatgccaaccctg

SEQ ID NO: 24661 - DNA, 20 bp, Artificial Sequence
  Description of Artificial Sequence: Synthetic oligonucleotide
  Target: FXN; (-) strand; PAM type: YTN; PAM sequence: TTC
acttcaggaggtatgccaac

SEQ ID NO: 24662 - DNA, 20 bp, Artificial Sequence
  Description of Artificial Sequence: Synthetic oligonucleotide
  Target: FXN; (-) strand; PAM type: YTN; PAM sequence: CTA
attcacttcaggaggtatgc

SEQ ID NO: 24663 - DNA, 20 bp, Artificial Sequence
  Description of Artificial Sequence: Synthetic oligonucleotide
  Target: FXN; (-) strand; PAM type: YTN; PAM sequence: TTC
ctaattcacttcaggaggta

SEQ ID NO: 24664 - DNA, 20 bp, Artificial Sequence
  Description of Artificial Sequence: Synthetic oligonucleotide
  Target: FXN; (-) strand; PAM type: YTN; PAM sequence: CTG
gaatgagtgtagttcctaat

SEQ ID NO: 24665 - DNA, 20 bp, Artificial Sequence
  Description of Artificial Sequence: Synthetic oligonucleotide
  Target: FXN; (-) strand; PAM type: YTN; PAM sequence: CTG
gaagctggaatgagtgtagt

SEQ ID NO: 24666 - DNA, 20 bp, Artificial Sequence
  Description of Artificial Sequence: Synthetic oligonucleotide
  Target: FXN; (-) strand; PAM type: YTN; PAM sequence: CTG
acagataaagaccaaactgg

SEQ ID NO: 24667 - DNA, 20 bp, Artificial Sequence
  Description of Artificial Sequence: Synthetic oligonucleotide
  Target: FXN; (-) strand; PAM type: YTN; PAM sequence: CTC
aacaatgcagaggacagtaa

SEQ ID NO: 24668 - DNA, 20 bp, Artificial Sequence
  Description of Artificial Sequence: Synthetic oligonucleotide
  Target: FXN; (-) strand; PAM type: YTN; PAM sequence: CTG
agactcaacaatgcagagga

SEQ ID NO: 24669 - DNA, 20 bp, Artificial Sequence
  Description of Artificial Sequence: Synthetic oligonucleotide
  Target: FXN; (-) strand; PAM type: YTN; PAM sequence: TTG
gacaaggtgactgagactca

SEQ ID NO: 24670 - DNA, 20 bp, Artificial Sequence
  Description of Artificial Sequence: Synthetic oligonucleotide
  Target: FXN; (-) strand; PAM type: YTN; PAM sequence: CTT
ggacaaggtgactgagactc

SEQ ID NO: 24671 - DNA, 20 bp, Artificial Sequence
  Description of Artificial Sequence: Synthetic oligonucleotide
  Target: FXN; (-) strand; PAM type: YTN; PAM sequence: CTG
gccaatggaacttggacaag

SEQ ID NO: 24672 - DNA, 20 bp, Artificial Sequence
  Description of Artificial Sequence: Synthetic oligonucleotide
  Target: FXN; (-) strand; PAM type: YTN; PAM sequence: TTC
tggccaatggaacttggaca

SEQ ID NO: 24673 - DNA, 20 bp, Artificial Sequence
  Description of Artificial Sequence: Synthetic oligonucleotide
  Target: FXN; (-) strand; PAM type: YTN; PAM sequence: TTT
ctggccaatggaacttggac

SEQ ID NO: 24674 - DNA, 20 bp, Artificial Sequence
  Description of Artificial Sequence: Synthetic oligonucleotide
  Target: FXN; (-) strand; PAM type: YTN; PAM sequence: CTT
tctggccaatggaacttgga

SEQ ID NO: 24675 - DNA, 20 bp, Artificial Sequence
  Description of Artificial Sequence: Synthetic oligonucleotide
  Target: FXN; (-) strand; PAM type: YTN; PAM sequence: CTA
gccctttctggccaatggaa

SEQ ID NO: 24676 - DNA, 20 bp, Artificial Sequence
  Description of Artificial Sequence: Synthetic oligonucleotide
  Target: FXN; (-) strand; PAM type: YTN; PAM sequence: TTC
tagccctttctggccaatgg

SEQ ID NO: 24677 - DNA, 20 bp, Artificial Sequence
  Description of Artificial Sequence: Synthetic oligonucleotide
  Target: FXN; (-) strand; PAM type: YTN; PAM sequence: CTT
ctagccctttctggccaatg

SEQ ID NO: 24678 - DNA, 20 bp, Artificial Sequence
  Description of Artificial Sequence: Synthetic oligonucleotide
  Target: FXN; (-) strand; PAM type: YTN; PAM sequence: CTG
tgcttctagccctttctggc

SEQ ID NO: 24679 - DNA, 20 bp, Artificial Sequence
  Description of Artificial Sequence: Synthetic oligonucleotide
  Target: FXN; (-) strand; PAM type: YTN; PAM sequence: TTC
tgtgcttctagccctttctg

SEQ ID NO: 24680 - DNA, 20 bp, Artificial Sequence
  Description of Artificial Sequence: Synthetic oligonucleotide
  Target: FXN; (-) strand; PAM type: YTN; PAM sequence: CTT
ctgtgcttctagccctttct

SEQ ID NO: 24681 - DNA, 20 bp, Artificial Sequence
  Description of Artificial Sequence: Synthetic oligonucleotide
  Target: FXN; (-) strand; PAM type: YTN; PAM sequence: TTC
cagcccttctgtgcttctag

SEQ ID NO: 24682 - DNA, 20 bp, Artificial Sequence
  Description of Artificial Sequence: Synthetic oligonucleotide
  Target: FXN; (-) strand; PAM type: YTN; PAM sequence: CTT
ccagcccttctgtgcttcta

SEQ ID NO: 24683 - DNA, 20 bp, Artificial Sequence
  Description of Artificial Sequence: Synthetic oligonucleotide
  Target: FXN; (-) strand; PAM type: YTN; PAM sequence: TTC
ccaccagaatgtgagtgagg

SEQ ID NO: 24684 - DNA, 20 bp, Artificial Sequence
  Description of Artificial Sequence: Synthetic oligonucleotide
  Target: FXN; (-) strand; PAM type: YTN; PAM sequence: CTT
cccaccagaatgtgagtgag

SEQ ID NO: 24685 - DNA, 20 bp, Artificial Sequence
  Description of Artificial Sequence: Synthetic oligonucleotide
  Target: FXN; (-) strand; PAM type: YTN; PAM sequence: TTC
ttcccaccagaatgtgagtg

SEQ ID NO: 24686 - DNA, 20 bp, Artificial Sequence
  Description of Artificial Sequence: Synthetic oligonucleotide
  Target: FXN; (-) strand; PAM type: YTN; PAM sequence: CTA
agttcttcccaccagaatgt

SEQ ID NO: 24687 - DNA, 20 bp, Artificial Sequence
  Description of Artificial Sequence: Synthetic oligonucleotide
  Target: FXN; (-) strand; PAM type: YTN; PAM sequence: CTA
aggccacaccactaagttct

SEQ ID NO: 24688 - DNA, 20 bp, Artificial Sequence
  Description of Artificial Sequence: Synthetic oligonucleotide
  Target: FXN; (-) strand; PAM type: YTN; PAM sequence: TTA
cagtcagctaaggccacacc

SEQ ID NO: 24689 - DNA, 20 bp, Artificial Sequence
  Description of Artificial Sequence: Synthetic oligonucleotide
  Target: FXN; (-) strand; PAM type: YTN; PAM sequence: CTT
acagtcagctaaggccacac

SEQ ID NO: 24690 - DNA, 20 bp, Artificial Sequence
  Description of Artificial Sequence: Synthetic oligonucleotide
  Target: FXN; (-) strand; PAM type: YTN; PAM sequence: CTC
ccttacagtcagctaaggcc

SEQ ID NO: 24691 - DNA, 20 bp, Artificial Sequence
  Description of Artificial Sequence: Synthetic oligonucleotide
  Target: FXN; (-) strand; PAM type: YTN; PAM sequence: TTC
ccagcctcccttacagtcag

SEQ ID NO: 24692 - DNA, 20 bp, Artificial Sequence
  Description of Artificial Sequence: Synthetic oligonucleotide
  Target: FXN; (-) strand; PAM type: YTN; PAM sequence: TTT
cccagcctcccttacagtca

SEQ ID NO: 24693 - DNA, 20 bp, Artificial Sequence
  Description of Artificial Sequence: Synthetic oligonucleotide
  Target: FXN; (-) strand; PAM type: YTN; PAM sequence: CTA
tatttcccagcctcccttac

SEQ ID NO: 24694 - DNA, 20 bp, Artificial Sequence
  Description of Artificial Sequence: Synthetic oligonucleotide
  Target: FXN; (-) strand; PAM type: YTN; PAM sequence: CTA
gactatatttcccagcctcc

SEQ ID NO: 24695 - DNA, 20 bp, Artificial Sequence
  Description of Artificial Sequence: Synthetic oligonucleotide
  Target: FXN; (-) strand; PAM type: YTN; PAM sequence: CTC
gctagactatatttcccagc

SEQ ID NO: 24696 - DNA, 20 bp, Artificial Sequence
  Description of Artificial Sequence: Synthetic oligonucleotide
  Target: FXN; (-) strand; PAM type: YTN; PAM sequence: TTC
cagggcactcgctagactat

SEQ ID NO: 24697 - DNA, 20 bp, Artificial Sequence
  Description of Artificial Sequence: Synthetic oligonucleotide
  Target: FXN; (-) strand; PAM type: YTN; PAM sequence: TTT
ccagggcactcgctagacta

SEQ ID NO: 24698 - DNA, 20 bp, Artificial Sequence
  Description of Artificial Sequence: Synthetic oligonucleotide
  Target: FXN; (-) strand; PAM type: YTN; PAM sequence: TTT
tccagggcactcgctagact

SEQ ID NO: 24699 - DNA, 20 bp, Artificial Sequence
  Description of Artificial Sequence: Synthetic oligonucleotide
  Target: FXN; (-) strand; PAM type: YTN; PAM sequence: TTT
ttccagggcactcgctagac

SEQ ID NO: 24700 - DNA, 20 bp, Artificial Sequence
  Description of Artificial Sequence: Synthetic oligonucleotide
  Target: FXN; (-) strand; PAM type: YTN; PAM sequence: CTT
tttccagggcactcgctaga

SEQ ID NO: 24701 - DNA, 20 bp, Artificial Sequence
  Description of Artificial Sequence: Synthetic oligonucleotide
  Target: FXN; (-) strand; PAM type: YTN; PAM sequence: TTC
catggggaatgccgtgccgg

SEQ ID NO: 24702 - DNA, 20 bp, Artificial Sequence
  Description of Artificial Sequence: Synthetic oligonucleotide
  Target: FXN; (-) strand; PAM type: YTN; PAM sequence: TTT
ccatggggaatgccgtgccg

SEQ ID NO: 24703 - DNA, 20 bp, Artificial Sequence
  Description of Artificial Sequence: Synthetic oligonucleotide
  Target: FXN; (-) strand; PAM type: YTN; PAM sequence: CTT
tccatggggaatgccgtgcc

SEQ ID NO: 24704 - DNA, 20 bp, Artificial Sequence
  Description of Artificial Sequence: Synthetic oligonucleotide
  Target: FXN; (-) strand; PAM type: YTN; PAM sequence: CTG
acagctttccatggggaatg

SEQ ID NO: 24705 - DNA, 20 bp, Artificial Sequence
  Description of Artificial Sequence: Synthetic oligonucleotide
  Target: FXN; (-) strand; PAM type: YTN; PAM sequence: CTG
tagccgtgcctgacagcttt

SEQ ID NO: 24706 - DNA, 20 bp, Artificial Sequence
  Description of Artificial Sequence: Synthetic oligonucleotide
  Target: FXN; (-) strand; PAM type: YTN; PAM sequence: TTG
gcagggggtagactgtagcc

SEQ ID NO: 24707 - DNA, 20 bp, Artificial Sequence
  Description of Artificial Sequence: Synthetic oligonucleotide
  Target: FXN; (-) strand; PAM type: YTN; PAM sequence: CTG
gttggcagggggtagactgt

SEQ ID NO: 24708 - DNA, 20 bp, Artificial Sequence
  Description of Artificial Sequence: Synthetic oligonucleotide
  Target: FXN; (-) strand; PAM type: YTN; PAM sequence: CTG
agtgtggaaggagggtccat

SEQ ID NO: 24709 - DNA, 20 bp, Artificial Sequence
  Description of Artificial Sequence: Synthetic oligonucleotide
  Target: FXN; (-) strand; PAM type: YTN; PAM sequence: CTG
ggggtaaatgcatctgagtg

SEQ ID NO: 24710 - DNA, 20 bp, Artificial Sequence
  Description of Artificial Sequence: Synthetic oligonucleotide
  Target: FXN; (-) strand; PAM type: YTN; PAM sequence: TTG
gggctgggggtaaatgcatc

SEQ ID NO: 24711 - DNA, 20 bp, Artificial Sequence
  Description of Artificial Sequence: Synthetic oligonucleotide
  Target: FXN; (-) strand; PAM type: YTN; PAM sequence: CTT
ggggctgggggtaaatgcat

SEQ ID NO: 24712 - DNA, 20 bp, Artificial Sequence
  Description of Artificial Sequence: Synthetic oligonucleotide
  Target: FXN; (-) strand; PAM type: YTN; PAM sequence: CTC
ttggggctgggggtaaatgc

SEQ ID NO: 24713 - DNA, 20 bp, Artificial Sequence
  Description of Artificial Sequence: Synthetic oligonucleotide
  Target: FXN; (-) strand; PAM type: YTN; PAM sequence: CTC
tcttggggctgggggtaaat

SEQ ID NO: 24714 - DNA, 20 bp, Artificial Sequence
  Description of Artificial Sequence: Synthetic oligonucleotide
  Target: FXN; (-) strand; PAM type: YTN; PAM sequence: TTG
gctctcttggggctgggggt

SEQ ID NO: 24715 - DNA, 20 bp, Artificial Sequence
  Description of Artificial Sequence: Synthetic oligonucleotide
  Target: FXN; (-) strand; PAM type: YTN; PAM sequence: CTG
tggtgaccacatgggcatcg

SEQ ID NO: 24716 - DNA, 20 bp, Artificial Sequence
  Description of Artificial Sequence: Synthetic oligonucleotide
  Target: FXN; (-) strand; PAM type: YTN; PAM sequence: CTC
ggaggtggctgtggtgacca

SEQ ID NO: 24717 - DNA, 20 bp, Artificial Sequence
  Description of Artificial Sequence: Synthetic oligonucleotide
  Target: FXN; (-) strand; PAM type: YTN; PAM sequence: TTG
gactcggaggtggctgtggt

SEQ ID NO: 24718 - DNA, 20 bp, Artificial Sequence
  Description of Artificial Sequence: Synthetic oligonucleotide
  Target: FXN; (-) strand; PAM type: YTN; PAM sequence: CTT
ggactcggaggtggctgtgg

SEQ ID NO: 24719 - DNA, 20 bp, Artificial Sequence
  Description of Artificial Sequence: Synthetic oligonucleotide
  Target: FXN; (-) strand; PAM type: YTN; PAM sequence: CTG
gaaatcttggactcggaggt

SEQ ID NO: 24720 - DNA, 20 bp, Artificial Sequence
  Description of Artificial Sequence: Synthetic oligonucleotide
  Target: FXN; (-) strand; PAM type: YTN; PAM sequence: CTG
catgtcacctggaaatcttg

SEQ ID NO: 24721 - DNA, 20 bp, Artificial Sequence
  Description of Artificial Sequence: Synthetic oligonucleotide
  Target: FXN; (-) strand; PAM type: YTN; PAM sequence: CTG
ggagagaggagactgcatgt

SEQ ID NO: 24722 - DNA, 20 bp, Artificial Sequence
  Description of Artificial Sequence: Synthetic oligonucleotide
  Target: FXN; (-) strand; PAM type: YTN; PAM sequence: CTA
aagctgggagagaggagact

SEQ ID NO: 24723 - DNA, 20 bp, Artificial Sequence
  Description of Artificial Sequence: Synthetic oligonucleotide
  Target: FXN; (-) strand; PAM type: YTN; PAM sequence: TTC
ctaaagctgggagagaggag

SEQ ID NO: 24724 - DNA, 20 bp, Artificial Sequence
  Description of Artificial Sequence: Synthetic oligonucleotide
  Target: FXN; (-) strand; PAM type: YTN; PAM sequence: CTG
tgtgtagatcagaagaagcc

SEQ ID NO: 24725 - DNA, 20 bp, Artificial Sequence
  Description of Artificial Sequence: Synthetic oligonucleotide
  Target: FXN; (-) strand; PAM type: YTN; PAM sequence: CTG
tgtctgtgtgtagatcagaa

SEQ ID NO: 24726 - DNA, 20 bp, Artificial Sequence
  Description of Artificial Sequence: Synthetic oligonucleotide
  Target: FXN; (-) strand; PAM type: YTN; PAM sequence: CTG
tgtgtgtgtgtctgtgtctg

SEQ ID NO: 24727 - DNA, 20 bp, Artificial Sequence
  Description of Artificial Sequence: Synthetic oligonucleotide
  Target: FXN; (-) strand; PAM type: YTN; PAM sequence: CTC
catcgtgtgtgtgtgtgtgt

SEQ ID NO: 24728 - DNA, 20 bp, Artificial Sequence
  Description of Artificial Sequence: Synthetic oligonucleotide
  Target: FXN; (-) strand; PAM type: YTN; PAM sequence: CTC
tccatcgtgtgtgtgtgtgt

SEQ ID NO: 24729 - DNA, 20 bp, Artificial Sequence
  Description of Artificial Sequence: Synthetic oligonucleotide
  Target: FXN; (-) strand; PAM type: YTN; PAM sequence: CTG
cccctctccatcgtgtgtgt

SEQ ID NO: 24730 - DNA, 20 bp, Artificial Sequence
  Description of Artificial Sequence: Synthetic oligonucleotide
  Target: FXN; (-) strand; PAM type: YTN; PAM sequence: TTA
tcctgcccctctccatcgtg

SEQ ID NO: 24731 - DNA, 20 bp, Artificial Sequence
  Description of Artificial Sequence: Synthetic oligonucleotide
  Target: FXN; (-) strand; PAM type: YTN; PAM sequence: TTG
cagttatcctgcccctctcc

SEQ ID NO: 24732 - DNA, 20 bp, Artificial Sequence
  Description of Artificial Sequence: Synthetic oligonucleotide
  Target: FXN; (-) strand; PAM type: YTN; PAM sequence: TTA
cagttgcagttatcctgccc

SEQ ID NO: 24733 - DNA, 20 bp, Artificial Sequence
  Description of Artificial Sequence: Synthetic oligonucleotide
  Target: FXN; (-) strand; PAM type: YTN; PAM sequence: CTG
aatggagttacagttgcagt

SEQ ID NO: 24734 - DNA, 20 bp, Artificial Sequence
  Description of Artificial Sequence: Synthetic oligonucleotide
  Target: FXN; (-) strand; PAM type: YTN; PAM sequence: TTC
tgaatggagttacagttgca

SEQ ID NO: 24735 - DNA, 20 bp, Artificial Sequence
  Description of Artificial Sequence: Synthetic oligonucleotide
  Target: FXN; (-) strand; PAM type: YTN; PAM sequence: TTT
ctgaatggagttacagttgc

SEQ ID NO: 24736 - DNA, 20 bp, Artificial Sequence
  Description of Artificial Sequence: Synthetic oligonucleotide
  Target: FXN; (-) strand; PAM type: YTN; PAM sequence: TTT
tctgaatggagttacagttg

SEQ ID NO: 24737 - DNA, 20 bp, Artificial Sequence
  Description of Artificial Sequence: Synthetic oligonucleotide
  Target: FXN; (-) strand; PAM type: YTN; PAM sequence: CTT
ttctgaatggagttacagtt

SEQ ID NO: 24738 - DNA, 20 bp, Artificial Sequence
  Description of Artificial Sequence: Synthetic oligonucleotide
  Target: FXN; (-) strand; PAM type: YTN; PAM sequence: CTC
ttttctgaatggagttacag

SEQ ID NO: 24739 - DNA, 20 bp, Artificial Sequence
  Description of Artificial Sequence: Synthetic oligonucleotide
  Target: FXN; (-) strand; PAM type: YTN; PAM sequence: CTG
tgcctcttttctgaatggag

SEQ ID NO: 24740 - DNA, 20 bp, Artificial Sequence
  Description of Artificial Sequence: Synthetic oligonucleotide
  Target: FXN; (-) strand; PAM type: YTN; PAM sequence: CTA
gtgctgtgcctcttttctga

SEQ ID NO: 24741 - DNA, 20 bp, Artificial Sequence
  Description of Artificial Sequence: Synthetic oligonucleotide
  Target: FXN; (-) strand; PAM type: YTN; PAM sequence: CTG
cgggcagctagtgctgtgcc

SEQ ID NO: 24742 - DNA, 20 bp, Artificial Sequence
  Description of Artificial Sequence: Synthetic oligonucleotide
  Target: FXN; (-) strand; PAM type: YTN; PAM sequence: CTC
cagtgctgcgggcagctagt

SEQ ID NO: 24743 - DNA, 20 bp, Artificial Sequence
  Description of Artificial Sequence: Synthetic oligonucleotide
  Target: FXN; (-) strand; PAM type: YTN; PAM sequence: CTG
cccagcagggctccagtgct

SEQ ID NO: 24744 - DNA, 20 bp, Artificial Sequence
  Description of Artificial Sequence: Synthetic oligonucleotide
  Target: FXN; (-) strand; PAM type: YTN; PAM sequence: TTG
atccagtgctgcccagcagg

SEQ ID NO: 24745 - DNA, 20 bp, Artificial Sequence
  Description of Artificial Sequence: Synthetic oligonucleotide
  Target: FXN; (-) strand; PAM type: YTN; PAM sequence: CTG
ccagggcagaggttgatcca

SEQ ID NO: 24746 - DNA, 20 bp, Artificial Sequence
  Description of Artificial Sequence: Synthetic oligonucleotide
  Target: FXN; (-) strand; PAM type: YTN; PAM sequence: CTC
tgccagggcagaggttgatc

SEQ ID NO: 24747 - DNA, 20 bp, Artificial Sequence
  Description of Artificial Sequence: Synthetic oligonucleotide
  Target: FXN; (-) strand; PAM type: YTN; PAM sequence: CTC
ctctgccagggcagaggttg

SEQ ID NO: 24748 - DNA, 20 bp, Artificial Sequence
  Description of Artificial Sequence: Synthetic oligonucleotide
  Target: FXN; (-) strand; PAM type: YTN; PAM sequence: TTG
tggaggaacatgctcctctg

SEQ ID NO: 24749 - DNA, 20 bp, Artificial Sequence
  Description of Artificial Sequence: Synthetic oligonucleotide
  Target: FXN; (-) strand; PAM type: YTN; PAM sequence: TTT
gtggaggaacatgctcctct

SEQ ID NO: 24750 - DNA, 20 bp, Artificial Sequence
  Description of Artificial Sequence: Synthetic oligonucleotide
  Target: FXN; (-) strand; PAM type: YTN; PAM sequence: CTG
aagcagggatttgtggagga

SEQ ID NO: 24751 - DNA, 20 bp, Artificial Sequence
  Description of Artificial Sequence: Synthetic oligonucleotide
  Target: FXN; (-) strand; PAM type: YTN; PAM sequence: CTC
gagaggctgaagcagggatt

SEQ ID NO: 24752 - DNA, 20 bp, Artificial Sequence
  Description of Artificial Sequence: Synthetic oligonucleotide
  Target: FXN; (-) strand; PAM type: YTN; PAM sequence: CTC
tcgagaggctgaagcaggga

SEQ ID NO: 24753 - DNA, 20 bp, Artificial Sequence
  Description of Artificial Sequence: Synthetic oligonucleotide
  Target: FXN; (-) strand; PAM type: YTN; PAM sequence: TTG
tggccaaggaaaataacaga

SEQ ID NO: 24754 - DNA, 20 bp, Artificial Sequence
  Description of Artificial Sequence: Synthetic oligonucleotide
  Target: FXN; (-) strand; PAM type: YTN; PAM sequence: CTT
gtggccaaggaaaataacag

SEQ ID NO: 24755 - DNA, 20 bp, Artificial Sequence
  Description of Artificial Sequence: Synthetic oligonucleotide
  Target: FXN; (-) strand; PAM type: YTN; PAM sequence: CTG
ccttgtggccaaggaaaata

SEQ ID NO: 24756 - DNA, 20 bp, Artificial Sequence
  Description of Artificial Sequence: Synthetic oligonucleotide
  Target: FXN; (-) strand; PAM type: YTN; PAM sequence: CTG
cctgccttgtggccaaggaa

SEQ ID NO: 24757 - DNA, 20 bp, Artificial Sequence
  Description of Artificial Sequence: Synthetic oligonucleotide
  Target: FXN; (-) strand; PAM type: YTN; PAM sequence: CTG
cctgcctgccttgtggccaa

SEQ ID NO: 24758 - DNA, 20 bp, Artificial Sequence
  Description of Artificial Sequence: Synthetic oligonucleotide
  Target: FXN; (-) strand; PAM type: YTN; PAM sequence: TTC
ccactgcctgcctgccttgt

SEQ ID NO: 24759 - DNA, 20 bp, Artificial Sequence
  Description of Artificial Sequence: Synthetic oligonucleotide
  Target: FXN; (-) strand; PAM type: YTN; PAM sequence: CTT
cccactgcctgcctgccttg

SEQ ID NO: 24760 - DNA, 20 bp, Artificial Sequence
  Description of Artificial Sequence: Synthetic oligonucleotide
  Target: FXN; (-) strand; PAM type: YTN; PAM sequence: TTG
ccccggaggagggcacactt

SEQ ID NO: 24761 - DNA, 20 bp, Artificial Sequence
  Description of Artificial Sequence: Synthetic oligonucleotide
  Target: FXN; (-) strand; PAM type: YTN; PAM sequence: CTT
gccccggaggagggcacact

SEQ ID NO: 24762 - DNA, 20 bp, Artificial Sequence
  Description of Artificial Sequence: Synthetic oligonucleotide
  Target: FXN; (-) strand; PAM type: YTN; PAM sequence: CTC
cttgccccggaggagggcac

SEQ ID NO: 24763 - DNA, 20 bp, Artificial Sequence
  Description of Artificial Sequence: Synthetic oligonucleotide
  Target: FXN; (-) strand; PAM type: YTN; PAM sequence: CTG
tgaaggctccttgccccgga

SEQ ID NO: 24764 - DNA, 20 bp, Artificial Sequence
  Description of Artificial Sequence: Synthetic oligonucleotide
  Target: FXN; (-) strand; PAM type: YTN; PAM sequence: TTA
gcaggaagtgggctgtgaag

SEQ ID NO: 24765 - DNA, 20 bp, Artificial Sequence
  Description of Artificial Sequence: Synthetic oligonucleotide
  Target: FXN; (-) strand; PAM type: YTN; PAM sequence: TTA
ttagcaggaagtgggctgtg

SEQ ID NO: 24766 - DNA, 20 bp, Artificial Sequence
  Description of Artificial Sequence: Synthetic oligonucleotide
  Target: FXN; (-) strand; PAM type: YTN; PAM sequence: CTG
ttattagcaggaagtgggct

SEQ ID NO: 24767 - DNA, 20 bp, Artificial Sequence
  Description of Artificial Sequence: Synthetic oligonucleotide
  Target: FXN; (-) strand; PAM type: YTN; PAM sequence: CTG
tggaaccccaaactgttatt

SEQ ID NO: 24768 - DNA, 20 bp, Artificial Sequence
  Description of Artificial Sequence: Synthetic oligonucleotide
  Target: FXN; (-) strand; PAM type: YTN; PAM sequence: TTA
aaacaccctgtggaacccca

SEQ ID NO: 24769 - DNA, 20 bp, Artificial Sequence
  Description of Artificial Sequence: Synthetic oligonucleotide
  Target: FXN; (-) strand; PAM type: YTN; PAM sequence: CTT
aaaacaccctgtggaacccc

SEQ ID NO: 24770 - DNA, 20 bp, Artificial Sequence
  Description of Artificial Sequence: Synthetic oligonucleotide
  Target: FXN; (-) strand; PAM type: YTN; PAM sequence: CTG
gagtcttaaaacaccctgtg

SEQ ID NO: 24771 - DNA, 20 bp, Artificial Sequence
  Description of Artificial Sequence: Synthetic oligonucleotide
  Target: FXN; (-) strand; PAM type: YTN; PAM sequence: CTG
actggagtcttaaaacaccc

SEQ ID NO: 24772 - DNA, 20 bp, Artificial Sequence
  Description of Artificial Sequence: Synthetic oligonucleotide
  Target: FXN; (-) strand; PAM type: YTN; PAM sequence: CTA
aaatagctgactggagtctt

SEQ ID NO: 24773 - DNA, 20 bp, Artificial Sequence
  Description of Artificial Sequence: Synthetic oligonucleotide
  Target: FXN; (-) strand; PAM type: YTN; PAM sequence: CTG
gcctaaaatagctgactgga

SEQ ID NO: 24774 - DNA, 20 bp, Artificial Sequence
  Description of Artificial Sequence: Synthetic oligonucleotide
  Target: FXN; (-) strand; PAM type: YTN; PAM sequence: TTC
ataaaagaaaaaaaaagaga

SEQ ID NO: 24775 - DNA, 20 bp, Artificial Sequence
  Description of Artificial Sequence: Synthetic oligonucleotide
  Target: FXN; (-) strand; PAM type: YTN; PAM sequence: TTT
cataaaagaaaaaaaaagag

SEQ ID NO: 24776 - DNA, 20 bp, Artificial Sequence
  Description of Artificial Sequence: Synthetic oligonucleotide
  Target: FXN; (-) strand; PAM type: YTN; PAM sequence: CTC
agggtgtgatttcataaaag

SEQ ID NO: 24777 - DNA, 20 bp, Artificial Sequence
  Description of Artificial Sequence: Synthetic oligonucleotide
  Target: FXN; (-) strand; PAM type: YTN; PAM sequence: CTG
ggtctcagggtgtgatttca

SEQ ID NO: 24778 - DNA, 20 bp, Artificial Sequence
  Description of Artificial Sequence: Synthetic oligonucleotide
  Target: FXN; (-) strand; PAM type: YTN; PAM sequence: CTC
cagcctgggtctcagggtgt

SEQ ID NO: 24779 - DNA, 20 bp, Artificial Sequence
  Description of Artificial Sequence: Synthetic oligonucleotide
  Target: FXN; (-) strand; PAM type: YTN; PAM sequence: CTG
cactccagcctgggtctcag

SEQ ID NO: 24780 - DNA, 20 bp, Artificial Sequence
  Description of Artificial Sequence: Synthetic oligonucleotide
  Target: FXN; (-) strand; PAM type: YTN; PAM sequence: CTG
cagtgagccgagatcgcacc

SEQ ID NO: 24781 - DNA, 20 bp, Artificial Sequence
  Description of Artificial Sequence: Synthetic oligonucleotide
  Target: FXN; (-) strand; PAM type: YTN; PAM sequence: TTG
aacccgggaggcggaggctg

SEQ ID NO: 24782 - DNA, 20 bp, Artificial Sequence
  Description of Artificial Sequence: Synthetic oligonucleotide
  Target: FXN; (-) strand; PAM type: YTN; PAM sequence: CTT
gaacccgggaggcggaggct

SEQ ID NO: 24783 - DNA, 20 bp, Artificial Sequence
  Description of Artificial Sequence: Synthetic oligonucleotide
  Target: FXN; (-) strand; PAM type: YTN; PAM sequence: TTG
cttgaacccgggaggcggag

SEQ ID NO: 24784 - DNA, 20 bp, Artificial Sequence
  Description of Artificial Sequence: Synthetic oligonucleotide
  Target: FXN; (-) strand; PAM type: YTN; PAM sequence: CTG
aggcaggaggattgcttgaa

SEQ ID NO: 24785 - DNA, 20 bp, Artificial Sequence
  Description of Artificial Sequence: Synthetic oligonucleotide
  Target: FXN; (-) strand; PAM type: YTN; PAM sequence: CTC
aggaggctgaggcaggagga

SEQ ID NO: 24786 - DNA, 20 bp, Artificial Sequence
  Description of Artificial Sequence: Synthetic oligonucleotide
  Target: FXN; (-) strand; PAM type: YTN; PAM sequence: CTA
ctcaggaggctgaggcagga

SEQ ID NO: 24787 - DNA, 20 bp, Artificial Sequence
  Description of Artificial Sequence: Synthetic oligonucleotide
  Target: FXN; (-) strand; PAM type: YTN; PAM sequence: CTA
tagtcccagctactcaggag

SEQ ID NO: 24788 - DNA, 20 bp, Artificial Sequence
  Description of Artificial Sequence: Synthetic oligonucleotide
  Target: FXN; (-) strand; PAM type: YTN; PAM sequence: CTG
cacgcctatagtcccagcta

SEQ ID NO: 24789 - DNA, 20 bp, Artificial Sequence
  Description of Artificial Sequence: Synthetic oligonucleotide
  Target: FXN; (-) strand; PAM type: YTN; PAM sequence: CTA
ggtgtggcactgcacgccta

SEQ ID NO: 24790 - DNA, 20 bp, Artificial Sequence
  Description of Artificial Sequence: Synthetic oligonucleotide
  Target: FXN; (-) strand; PAM type: YTN; PAM sequence: TTA
gctaggtgtggcactgcacg

SEQ ID NO: 24791 - DNA, 20 bp, Artificial Sequence
  Description of Artificial Sequence: Synthetic oligonucleotide
  Target: FXN; (-) strand; PAM type: YTN; PAM sequence: CTA
aaaatacaaaaattagctag

SEQ ID NO: 24792 - DNA, 20 bp, Artificial Sequence
  Description of Artificial Sequence: Synthetic oligonucleotide
  Target: FXN; (-) strand; PAM type: YTN; PAM sequence: TTA
ctaaaaatacaaaaattagc

SEQ ID NO: 24793 - DNA, 20 bp, Artificial Sequence
  Description of Artificial Sequence: Synthetic oligonucleotide
  Target: FXN; (-) strand; PAM type: YTN; PAM sequence: TTT
actaaaaatacaaaaattag

SEQ ID NO: 24794 - DNA, 20 bp, Artificial Sequence
  Description of Artificial Sequence: Synthetic oligonucleotide
  Target: FXN; (-) strand; PAM type: YTN; PAM sequence: CTT
tactaaaaatacaaaaatta

SEQ ID NO: 24795 - DNA, 20 bp, Artificial Sequence
  Description of Artificial Sequence: Synthetic oligonucleotide
  Target: FXN; (-) strand; PAM type: YTN; PAM sequence: CTG
gccaacatggtgaaaccccg

SEQ ID NO: 24796 - DNA, 20 bp, Artificial Sequence
  Description of Artificial Sequence: Synthetic oligonucleotide
  Target: FXN; (-) strand; PAM type: YTN; PAM sequence: TTC
aagaccagcctggccaacat

SEQ ID NO: 24797 - DNA, 20 bp, Artificial Sequence
  Description of Artificial Sequence: Synthetic oligonucleotide
  Target: FXN; (-) strand; PAM type: YTN; PAM sequence: CTG
aggtcaggagttcaagacca

SEQ ID NO: 24798 - DNA, 20 bp, Artificial Sequence
  Description of Artificial Sequence: Synthetic oligonucleotide
  Target: FXN; (-) strand; PAM type: YTN; PAM sequence: TTG
ggaggccgaggcgggcggat

SEQ ID NO: 24799 - DNA, 20 bp, Artificial Sequence
  Description of Artificial Sequence: Synthetic oligonucleotide
  Target: FXN; (-) strand; PAM type: YTN; PAM sequence: TTT
gggaggccgaggcgggcgga

SEQ ID NO: 24800 - DNA, 20 bp, Artificial Sequence
  Description of Artificial Sequence: Synthetic oligonucleotide
  Target: FXN; (-) strand; PAM type: YTN; PAM sequence: CTT
tgggaggccgaggcgggcgg

SEQ ID NO: 24801 - DNA, 20 bp, Artificial Sequence
  Description of Artificial Sequence: Synthetic oligonucleotide
  Target: FXN; (-) strand; PAM type: YTN; PAM sequence: CTC
atgccagtaatcccagcact

SEQ ID NO: 24802 - DNA, 20 bp, Artificial Sequence
  Description of Artificial Sequence: Synthetic oligonucleotide
  Target: FXN; (-) strand; PAM type: YTN; PAM sequence: CTG
ggcgcagtggctcatgccag

SEQ ID NO: 24803 - DNA, 20 bp, Artificial Sequence
  Description of Artificial Sequence: Synthetic oligonucleotide
  Target: FXN; (-) strand; PAM type: YTN; PAM sequence: CTG
ggctgggcgcagtggctcat

SEQ ID NO: 24804 - DNA, 20 bp, Artificial Sequence
  Description of Artificial Sequence: Synthetic oligonucleotide
  Target: FXN; (-) strand; PAM type: YTN; PAM sequence: CTC
aaagaaaaatgagtctgggc

SEQ ID NO: 24805 - DNA, 20 bp, Artificial Sequence
  Description of Artificial Sequence: Synthetic oligonucleotide
  Target: FXN; (-) strand; PAM type: YTN; PAM sequence: CTC
tcaaagaaaaatgagtctgg

SEQ ID NO: 24806 - DNA, 20 bp, Artificial Sequence
  Description of Artificial Sequence: Synthetic oligonucleotide
  Target: FXN; (-) strand; PAM type: YTN; PAM sequence: CTA
ctctcaaagaaaaatgagtc

SEQ ID NO: 24807 - DNA, 20 bp, Artificial Sequence
  Description of Artificial Sequence: Synthetic oligonucleotide
  Target: FXN; (-) strand; PAM type: YTN; PAM sequence: TTG
ggaaaagcctactctcaaag

SEQ ID NO: 24808 - DNA, 20 bp, Artificial Sequence
  Description of Artificial Sequence: Synthetic oligonucleotide
  Target: FXN; (-) strand; PAM type: YTN; PAM sequence: TTT
gggaaaagcctactctcaaa

SEQ ID NO: 24809 - DNA, 20 bp, Artificial Sequence
  Description of Artificial Sequence: Synthetic oligonucleotide
  Target: FXN; (-) strand; PAM type: YTN; PAM sequence: TTT
tgggaaaagcctactctcaa

SEQ ID NO: 24810 - DNA, 20 bp, Artificial Sequence
  Description of Artificial Sequence: Synthetic oligonucleotide
  Target: FXN; (-) strand; PAM type: YTN; PAM sequence: CTT
ttgggaaaagcctactctca

SEQ ID NO: 24811 - DNA, 20 bp, Artificial Sequence
  Description of Artificial Sequence: Synthetic oligonucleotide
  Target: FXN; (-) strand; PAM type: YTN; PAM sequence: CTA
cttttgggaaaagcctactc

SEQ ID NO: 24812 - DNA, 20 bp, Artificial Sequence
  Description of Artificial Sequence: Synthetic oligonucleotide
  Target: FXN; (-) strand; PAM type: YTN; PAM sequence: CTC
agaagcctacttttgggaaa

SEQ ID NO: 24813 - DNA, 20 bp, Artificial Sequence
  Description of Artificial Sequence: Synthetic oligonucleotide
  Target: FXN; (-) strand; PAM type: YTN; PAM sequence: CTG
aaagtgaatagctcagaagc

SEQ ID NO: 24814 - DNA, 20 bp, Artificial Sequence
  Description of Artificial Sequence: Synthetic oligonucleotide
  Target: FXN; (-) strand; PAM type: YTN; PAM sequence: CTG
cctgaaagtgaatagctcag

SEQ ID NO: 24815 - DNA, 20 bp, Artificial Sequence
  Description of Artificial Sequence: Synthetic oligonucleotide
  Target: FXN; (-) strand; PAM type: YTN; PAM sequence: CTG
gcacatgggactgcctgaaa

SEQ ID NO: 24816 - DNA, 20 bp, Artificial Sequence
  Description of Artificial Sequence: Synthetic oligonucleotide
  Target: FXN; (-) strand; PAM type: YTN; PAM sequence: TTC
ctggcacatgggactgcctg

SEQ ID NO: 24817 - DNA, 20 bp, Artificial Sequence
  Description of Artificial Sequence: Synthetic oligonucleotide
  Target: FXN; (-) strand; PAM type: YTN; PAM sequence: TTG
gatgtggttcctggcacatg

SEQ ID NO: 24818 - DNA, 20 bp, Artificial Sequence
  Description of Artificial Sequence: Synthetic oligonucleotide
  Target: FXN; (-) strand; PAM type: YTN; PAM sequence: TTT
ggatgtggttcctggcacat

SEQ ID NO: 24819 - DNA, 20 bp, Artificial Sequence
  Description of Artificial Sequence: Synthetic oligonucleotide
  Target: FXN; (-) strand; PAM type: YTN; PAM sequence: CTC
ccatccacggaggaaatttg

SEQ ID NO: 24820 - DNA, 20 bp, Artificial Sequence
  Description of Artificial Sequence: Synthetic oligonucleotide
  Target: FXN; (-) strand; PAM type: YTN; PAM sequence: CTG
agactcccatccacggagga

SEQ ID NO: 24821 - DNA, 20 bp, Artificial Sequence
  Description of Artificial Sequence: Synthetic oligonucleotide
  Target: FXN; (-) strand; PAM type: YTN; PAM sequence: CTG
ggcatggggacatgcaagga

SEQ ID NO: 24822 - DNA, 20 bp, Artificial Sequence
  Description of Artificial Sequence: Synthetic oligonucleotide
  Target: FXN; (-) strand; PAM type: YTN; PAM sequence: CTG
agacagctgggcatggggac

SEQ ID NO: 24823 - DNA, 20 bp, Artificial Sequence
  Description of Artificial Sequence: Synthetic oligonucleotide
  Target: FXN; (-) strand; PAM type: YTN; PAM sequence: TTA
ggctgagacagctgggcatg

SEQ ID NO: 24824 - DNA, 20 bp, Artificial Sequence
  Description of Artificial Sequence: Synthetic oligonucleotide
  Target: FXN; (-) strand; PAM type: YTN; PAM sequence: CTT
aggctgagacagctgggcat

SEQ ID NO: 24825 - DNA, 20 bp, Artificial Sequence
  Description of Artificial Sequence: Synthetic oligonucleotide
  Target: FXN; (-) strand; PAM type: YTN; PAM sequence: CTG
cccttaggctgagacagctg

SEQ ID NO: 24826 - DNA, 20 bp, Artificial Sequence
  Description of Artificial Sequence: Synthetic oligonucleotide
  Target: FXN; (-) strand; PAM type: YTN; PAM sequence: TTC
aaggtacctgcccttaggct

SEQ ID NO: 24827 - DNA, 20 bp, Artificial Sequence
  Description of Artificial Sequence: Synthetic oligonucleotide
  Target: FXN; (-) strand; PAM type: YTN; PAM sequence: CTT
caaggtacctgcccttaggc

SEQ ID NO: 24828 - DNA, 20 bp, Artificial Sequence
  Description of Artificial Sequence: Synthetic oligonucleotide
  Target: FXN; (-) strand; PAM type: YTN; PAM sequence: TTG
acttcaaggtacctgccctt

SEQ ID NO: 24829 - DNA, 20 bp, Artificial Sequence
  Description of Artificial Sequence: Synthetic oligonucleotide
  Target: FXN; (-) strand; PAM type: YTN; PAM sequence: CTT
gacttcaaggtacctgccct

SEQ ID NO: 24830 - DNA, 20 bp, Artificial Sequence
  Description of Artificial Sequence: Synthetic oligonucleotide
  Target: FXN; (-) strand; PAM type: YTN; PAM sequence: TTA
acttgacttcaaggtacctg

SEQ ID NO: 24831 - DNA, 20 bp, Artificial Sequence
  Description of Artificial Sequence: Synthetic oligonucleotide
  Target: FXN; (-) strand; PAM type: YTN; PAM sequence: TTT
aacttgacttcaaggtacct

SEQ ID NO: 24832 - DNA, 20 bp, Artificial Sequence
  Description of Artificial Sequence: Synthetic oligonucleotide
  Target: FXN; (-) strand; PAM type: YTN; PAM sequence: TTG
tttaacttgacttcaaggta

SEQ ID NO: 24833 - DNA, 20 bp, Artificial Sequence
  Description of Artificial Sequence: Synthetic oligonucleotide
  Target: FXN; (-) strand; PAM type: YTN; PAM sequence: TTA
ttgtttaacttgacttcaag

SEQ ID NO: 24834 - DNA, 20 bp, Artificial Sequence
  Description of Artificial Sequence: Synthetic oligonucleotide
  Target: FXN; (-) strand; PAM type: YTN; PAM sequence: CTT
attgtttaacttgacttcaa

SEQ ID NO: 24835 - DNA, 20 bp, Artificial Sequence
  Description of Artificial Sequence: Synthetic oligonucleotide
  Target: FXN; (-) strand; PAM type: YTN; PAM sequence: CTC
caatcttattgtttaacttg

SEQ ID NO: 24836 - DNA, 20 bp, Artificial Sequence
  Description of Artificial Sequence: Synthetic oligonucleotide
  Target: FXN; (-) strand; PAM type: YTN; PAM sequence: CTG
gtctccaatcttattgttta

SEQ ID NO: 24837 - DNA, 20 bp, Artificial Sequence
  Description of Artificial Sequence: Synthetic oligonucleotide
  Target: FXN; (-) strand; PAM type: YTN; PAM sequence: TTG
ctggtctccaatcttattgt

SEQ ID NO: 24838 - DNA, 20 bp, Artificial Sequence
  Description of Artificial Sequence: Synthetic oligonucleotide
  Target: FXN; (-) strand; PAM type: YTN; PAM sequence: CTG
agggcattgctggtctccaa

SEQ ID NO: 24839 - DNA, 20 bp, Artificial Sequence
  Description of Artificial Sequence: Synthetic oligonucleotide
  Target: FXN; (-) strand; PAM type: YTN; PAM sequence: CTG
caaaaaccaggctgagggca

SEQ ID NO: 24840 - DNA, 20 bp, Artificial Sequence
  Description of Artificial Sequence: Synthetic oligonucleotide
  Target: FXN; (-) strand; PAM type: YTN; PAM sequence: CTG
ctgcaaaaaccaggctgagg

SEQ ID NO: 24841 - DNA, 20 bp, Artificial Sequence
  Description of Artificial Sequence: Synthetic oligonucleotide
  Target: FXN; (-) strand; PAM type: YTN; PAM sequence: CTC
agtcctgctgcaaaaaccag

SEQ ID NO: 24842 - DNA, 20 bp, Artificial Sequence
  Description of Artificial Sequence: Synthetic oligonucleotide
  Target: FXN; (-) strand; PAM type: YTN; PAM sequence: TTG
agccaaaacaagggactcag

SEQ ID NO: 24843 - DNA, 20 bp, Artificial Sequence
  Description of Artificial Sequence: Synthetic oligonucleotide
  Target: FXN; (-) strand; PAM type: YTN; PAM sequence: TTC
ccattgagccaaaacaaggg

SEQ ID NO: 24844 - DNA, 20 bp, Artificial Sequence
  Description of Artificial Sequence: Synthetic oligonucleotide
  Target: FXN; (-) strand; PAM type: YTN; PAM sequence: CTT
cccattgagccaaaacaagg

SEQ ID NO: 24845 - DNA, 20 bp, Artificial Sequence
  Description of Artificial Sequence: Synthetic oligonucleotide
  Target: FXN; (-) strand; PAM type: YTN; PAM sequence: TTG
aacagcaaagacttcccatt

SEQ ID NO: 24846 - DNA, 20 bp, Artificial Sequence
  Description of Artificial Sequence: Synthetic oligonucleotide
  Target: FXN; (-) strand; PAM type: YTN; PAM sequence: TTT
gaacagcaaagacttcccat

SEQ ID NO: 24847 - DNA, 20 bp, Artificial Sequence
  Description of Artificial Sequence: Synthetic oligonucleotide
  Target: FXN; (-) strand; PAM type: YTN; PAM sequence: CTT
tgaacagcaaagacttccca

SEQ ID NO: 24848 - DNA, 20 bp, Artificial Sequence
  Description of Artificial Sequence: Synthetic oligonucleotide
  Target: FXN; (-) strand; PAM type: YTN; PAM sequence: CTA
aggctttgaacagcaaagac

SEQ ID NO: 24849 - DNA, 20 bp, Artificial Sequence
  Description of Artificial Sequence: Synthetic oligonucleotide
  Target: FXN; (-) strand; PAM type: YTN; PAM sequence: CTC
agccagagaagctaaggctt

SEQ ID NO: 24850 - DNA, 20 bp, Artificial Sequence
  Description of Artificial Sequence: Synthetic oligonucleotide
  Target: FXN; (-) strand; PAM type: YTN; PAM sequence: CTA
ggatgacaggcgtgagccac

SEQ ID NO: 24851 - DNA, 20 bp, Artificial Sequence
  Description of Artificial Sequence: Synthetic oligonucleotide
  Target: FXN; (-) strand; PAM type: YTN; PAM sequence: CTC
ccaaagagctaggatgacag

SEQ ID NO: 24852 - DNA, 20 bp, Artificial Sequence
  Description of Artificial Sequence: Synthetic oligonucleotide
  Target: FXN; (-) strand; PAM type: YTN; PAM sequence: CTC
ggcctcccaaagagctagga

SEQ ID NO: 24853 - DNA, 20 bp, Artificial Sequence
  Description of Artificial Sequence: Synthetic oligonucleotide
  Target: FXN; (-) strand; PAM type: YTN; PAM sequence: CTC
acctcggcctcccaaagagc

SEQ ID NO: 24854 - DNA, 20 bp, Artificial Sequence
  Description of Artificial Sequence: Synthetic oligonucleotide
  Target: FXN; (-) strand; PAM type: YTN; PAM sequence: CTG
ctcacctcggcctcccaaag

SEQ ID NO: 24855 - DNA, 20 bp, Artificial Sequence
  Description of Artificial Sequence: Synthetic oligonucleotide
  Target: FXN; (-) strand; PAM type: YTN; PAM sequence: CTC
agtgatctgctcacctcggc

SEQ ID NO: 24856 - DNA, 20 bp, Artificial Sequence
  Description of Artificial Sequence: Synthetic oligonucleotide
  Target: FXN; (-) strand; PAM type: YTN; PAM sequence: CTG
gcctcagtgatctgctcacc

SEQ ID NO: 24857 - DNA, 20 bp, Artificial Sequence
  Description of Artificial Sequence: Synthetic oligonucleotide
  Target: FXN; (-) strand; PAM type: YTN; PAM sequence: CTC
ctggcctcagtgatctgctc

SEQ ID NO: 24858 - DNA, 20 bp, Artificial Sequence
  Description of Artificial Sequence: Synthetic oligonucleotide
  Target: FXN; (-) strand; PAM type: YTN; PAM sequence: TTG
aactcctggcctcagtgatc

SEQ ID NO: 24859 - DNA, 20 bp, Artificial Sequence
  Description of Artificial Sequence: Synthetic oligonucleotide
  Target: FXN; (-) strand; PAM type: YTN; PAM sequence: CTT
gaactcctggcctcagtgat

SEQ ID NO: 24860 - DNA, 20 bp, Artificial Sequence
  Description of Artificial Sequence: Synthetic oligonucleotide
  Target: FXN; (-) strand; PAM type: YTN; PAM sequence: CTG
gtcttgaactcctggcctca

SEQ ID NO: 24861 - DNA, 20 bp, Artificial Sequence
  Description of Artificial Sequence: Synthetic oligonucleotide
  Target: FXN; (-) strand; PAM type: YTN; PAM sequence: TTG
gccaggctggtcttgaactc

SEQ ID NO: 24862 - DNA, 20 bp, Artificial Sequence
  Description of Artificial Sequence: Synthetic oligonucleotide
  Target: FXN; (-) strand; PAM type: YTN; PAM sequence: TTC
accatgttggccaggctggt

SEQ ID NO: 24863 - DNA, 20 bp, Artificial Sequence
  Description of Artificial Sequence: Synthetic oligonucleotide
  Target: FXN; (-) strand; PAM type: YTN; PAM sequence: TTT
caccatgttggccaggctgg

SEQ ID NO: 24864 - DNA, 20 bp, Artificial Sequence
  Description of Artificial Sequence: Synthetic oligonucleotide
  Target: FXN; (-) strand; PAM type: YTN; PAM sequence: TTA
gtagagacagggtttcacca

SEQ ID NO: 24865 - DNA, 20 bp, Artificial Sequence
  Description of Artificial Sequence: Synthetic oligonucleotide
  Target: FXN; (-) strand; PAM type: YTN; PAM sequence: TTT
agtagagacagggtttcacc

SEQ ID NO: 24866 - DNA, 20 bp, Artificial Sequence
  Description of Artificial Sequence: Synthetic oligonucleotide
  Target: FXN; (-) strand; PAM type: YTN; PAM sequence: TTT
tagtagagacagggtttcac

SEQ ID NO: 24867 - DNA, 20 bp, Artificial Sequence
  Description of Artificial Sequence: Synthetic oligonucleotide
  Target: FXN; (-) strand; PAM type: YTN; PAM sequence: TTT
ttagtagagacagggtttca

SEQ ID NO: 24868 - DNA, 20 bp, Artificial Sequence
  Description of Artificial Sequence: Synthetic oligonucleotide
  Target: FXN; (-) strand; PAM type: YTN; PAM sequence: TTG
tatttttagtagagacaggg

SEQ ID NO: 24869 - DNA, 20 bp, Artificial Sequence
  Description of Artificial Sequence: Synthetic oligonucleotide
  Target: FXN; (-) strand; PAM type: YTN; PAM sequence: TTT
gtatttttagtagagacagg

SEQ ID NO: 24870 - DNA, 20 bp, Artificial Sequence
  Description of Artificial Sequence: Synthetic oligonucleotide
  Target: FXN; (-) strand; PAM type: YTN; PAM sequence: TTT
tgtatttttagtagagacag

SEQ ID NO: 24871 - DNA, 20 bp, Artificial Sequence
  Description of Artificial Sequence: Synthetic oligonucleotide
  Target: FXN; (-) strand; PAM type: YTN; PAM sequence: TTT
ttgtatttttagtagagaca

SEQ ID NO: 24872 - DNA, 20 bp, Artificial Sequence
  Description of Artificial Sequence: Synthetic oligonucleotide
  Target: FXN; (-) strand; PAM type: YTN; PAM sequence: CTT
tttgtatttttagtagagac

SEQ ID NO: 24873 - DNA, 20 bp, Artificial Sequence
  Description of Artificial Sequence: Synthetic oligonucleotide
  Target: FXN; (-) strand; PAM type: YTN; PAM sequence: CTA
actttttgtatttttagtag

SEQ ID NO: 24874 - DNA, 20 bp, Artificial Sequence
  Description of Artificial Sequence: Synthetic oligonucleotide
  Target: FXN; (-) strand; PAM type: YTN; PAM sequence: CTG
gctaactttttgtattttta

SEQ ID NO: 24875 - DNA, 20 bp, Artificial Sequence
  Description of Artificial Sequence: Synthetic oligonucleotide
  Target: FXN; (-) strand; PAM type: YTN; PAM sequence: CTG
ccaccacgcctggctaactt

SEQ ID NO: 24876 - DNA, 20 bp, Artificial Sequence
  Description of Artificial Sequence: Synthetic oligonucleotide
  Target: FXN; (-) strand; PAM type: YTN; PAM sequence: TTA
caggtgcctgccaccacgcc

SEQ ID NO: 24877 - DNA, 20 bp, Artificial Sequence
  Description of Artificial Sequence: Synthetic oligonucleotide
  Target: FXN; (-) strand; PAM type: YTN; PAM sequence: CTG
ggattacaggtgcctgccac

SEQ ID NO: 24878 - DNA, 20 bp, Artificial Sequence
  Description of Artificial Sequence: Synthetic oligonucleotide
  Target: FXN; (-) strand; PAM type: YTN; PAM sequence: CTC
ccgagtagctgggattacag

SEQ ID NO: 24879 - DNA, 20 bp, Artificial Sequence
  Description of Artificial Sequence: Synthetic oligonucleotide
  Target: FXN; (-) strand; PAM type: YTN; PAM sequence: CTC
aggctcccgagtagctggga

SEQ ID NO: 24880 - DNA, 20 bp, Artificial Sequence
  Description of Artificial Sequence: Synthetic oligonucleotide
  Target: FXN; (-) strand; PAM type: YTN; PAM sequence: CTG
cctcaggctcccgagtagct

SEQ ID NO: 24881 - DNA, 20 bp, Artificial Sequence
  Description of Artificial Sequence: Synthetic oligonucleotide
  Target: FXN; (-) strand; PAM type: YTN; PAM sequence: CTC
ctgcctcaggctcccgagta

SEQ ID NO: 24882 - DNA, 20 bp, Artificial Sequence
  Description of Artificial Sequence: Synthetic oligonucleotide
  Target: FXN; (-) strand; PAM type: YTN; PAM sequence: TTC
tcctgcctcaggctcccgag

SEQ ID NO: 24883 - DNA, 20 bp, Artificial Sequence
  Description of Artificial Sequence: Synthetic oligonucleotide
  Target: FXN; (-) strand; PAM type: YTN; PAM sequence: TTA
agcgattctcctgcctcagg

SEQ ID NO: 24884 - DNA, 20 bp, Artificial Sequence
  Description of Artificial Sequence: Synthetic oligonucleotide
  Target: FXN; (-) strand; PAM type: YTN; PAM sequence: TTT
aagcgattctcctgcctcag

SEQ ID NO: 24885 - DNA, 20 bp, Artificial Sequence
  Description of Artificial Sequence: Synthetic oligonucleotide
  Target: FXN; (-) strand; PAM type: YTN; PAM sequence: CTG
ggtttaagcgattctcctgc

SEQ ID NO: 24886 - DNA, 20 bp, Artificial Sequence
  Description of Artificial Sequence: Synthetic oligonucleotide
  Target: FXN; (-) strand; PAM type: YTN; PAM sequence: CTC
ctgggtttaagcgattctcc

SEQ ID NO: 24887 - DNA, 20 bp, Artificial Sequence
  Description of Artificial Sequence: Synthetic oligonucleotide
  Target: FXN; (-) strand; PAM type: YTN; PAM sequence: CTC
catctcctgggtttaagcga

SEQ ID NO: 24888 - DNA, 20 bp, Artificial Sequence
  Description of Artificial Sequence: Synthetic oligonucleotide
  Target: FXN; (-) strand; PAM type: YTN; PAM sequence: CTG
cagcctccatctcctgggtt

SEQ ID NO: 24889 - DNA, 20 bp, Artificial Sequence
  Description of Artificial Sequence: Synthetic oligonucleotide
  Target: FXN; (-) strand; PAM type: YTN; PAM sequence: CTC
actgcagcctccatctcctg

SEQ ID NO: 24890 - DNA, 20 bp, Artificial Sequence
  Description of Artificial Sequence: Synthetic oligonucleotide
  Target: FXN; (-) strand; PAM type: YTN; PAM sequence: CTC
agctcactgcagcctccatc

SEQ ID NO: 24891 - DNA, 20 bp, Artificial Sequence
  Description of Artificial Sequence: Synthetic oligonucleotide
  Target: FXN; (-) strand; PAM type: YTN; PAM sequence: CTG
gagtgcaatggcatgatctc

SEQ ID NO: 24892 - DNA, 20 bp, Artificial Sequence
  Description of Artificial Sequence: Synthetic oligonucleotide
  Target: FXN; (-) strand; PAM type: YTN; PAM sequence: TTA
cccaggctggagtgcaatgg

SEQ ID NO: 24893 - DNA, 20 bp, Artificial Sequence
  Description of Artificial Sequence: Synthetic oligonucleotide
  Target: FXN; (-) strand; PAM type: YTN; PAM sequence: CTC
gttacccaggctggagtgca

SEQ ID NO: 24894 - DNA, 20 bp, Artificial Sequence
  Description of Artificial Sequence: Synthetic oligonucleotide
  Target: FXN; (-) strand; PAM type: YTN; PAM sequence: TTC
gctcgttacccaggctggag

SEQ ID NO: 24895 - DNA, 20 bp, Artificial Sequence
  Description of Artificial Sequence: Synthetic oligonucleotide
  Target: FXN; (-) strand; PAM type: YTN; PAM sequence: TTT
cgctcgttacccaggctgga

SEQ ID NO: 24896 - DNA, 20 bp, Artificial Sequence
  Description of Artificial Sequence: Synthetic oligonucleotide
  Target: FXN; (-) strand; PAM type: YTN; PAM sequence: TTA
gagatggaatttcgctcgtt

SEQ ID NO: 24897 - DNA, 20 bp, Artificial Sequence
  Description of Artificial Sequence: Synthetic oligonucleotide
  Target: FXN; (-) strand; PAM type: YTN; PAM sequence: TTT
agagatggaatttcgctcgt

SEQ ID NO: 24898 - DNA, 20 bp, Artificial Sequence
  Description of Artificial Sequence: Synthetic oligonucleotide
  Target: FXN; (-) strand; PAM type: YTN; PAM sequence: TTT
tagagatggaatttcgctcg

SEQ ID NO: 24899 - DNA, 20 bp, Artificial Sequence
  Description of Artificial Sequence: Synthetic oligonucleotide
  Target: FXN; (-) strand; PAM type: YTN; PAM sequence: TTT
ttagagatggaatttcgctc

SEQ ID NO: 24900 - DNA, 20 bp, Artificial Sequence
  Description of Artificial Sequence: Synthetic oligonucleotide
  Target: FXN; (-) strand; PAM type: YTN; PAM sequence: TTT
tttagagatggaatttcgct

SEQ ID NO: 24901 - DNA, 20 bp, Artificial Sequence
  Description of Artificial Sequence: Synthetic oligonucleotide
  Target: FXN; (-) strand; PAM type: YTN; PAM sequence: TTT
ttttagagatggaatttcgc

SEQ ID NO: 24902 - DNA, 20 bp, Artificial Sequence
  Description of Artificial Sequence: Synthetic oligonucleotide
  Target: FXN; (-) strand; PAM type: YTN; PAM sequence: TTT
tttttagagatggaatttcg

SEQ ID NO: 24903 - DNA, 20 bp, Artificial Sequence
  Description of Artificial Sequence: Synthetic oligonucleotide
  Target: FXN; (-) strand; PAM type: YTN; PAM sequence: CTT
ttttttagagatggaatttc

SEQ ID NO: 24904 - DNA, 20 bp, Artificial Sequence
  Description of Artificial Sequence: Synthetic oligonucleotide
  Target: FXN; (-) strand; PAM type: YTN; PAM sequence: TTC
ttttttttagagatggaatt

SEQ ID NO: 24905 - DNA, 20 bp, Artificial Sequence
  Description of Artificial Sequence: Synthetic oligonucleotide
  Target: FXN; (-) strand; PAM type: YTN; PAM sequence: TTT
cttttttttagagatggaat

SEQ ID NO: 24906 - DNA, 20 bp, Artificial Sequence
  Description of Artificial Sequence: Synthetic oligonucleotide
  Target: FXN; (-) strand; PAM type: YTN; PAM sequence: TTT
tcttttttttagagatggaa

SEQ ID NO: 24907 - DNA, 20 bp, Artificial Sequence
  Description of Artificial Sequence: Synthetic oligonucleotide
  Target: FXN; (-) strand; PAM type: YTN; PAM sequence: TTT
ttcttttttttagagatgga

SEQ ID NO: 24908 - DNA, 20 bp, Artificial Sequence
  Description of Artificial Sequence: Synthetic oligonucleotide
  Target: FXN; (-) strand; PAM type: YTN; PAM sequence: TTT
tttcttttttttagagatgg

SEQ ID NO: 24909 - DNA, 20 bp, Artificial Sequence
  Description of Artificial Sequence: Synthetic oligonucleotide
  Target: FXN; (-) strand; PAM type: YTN; PAM sequence: TTT
ttttcttttttttagagatg

SEQ ID NO: 24910 - DNA, 20 bp, Artificial Sequence
  Description of Artificial Sequence: Synthetic oligonucleotide
  Target: FXN; (-) strand; PAM type: YTN; PAM sequence: TTT
tttttcttttttttagagat

SEQ ID NO: 24911 - DNA, 20 bp, Artificial Sequence
  Description of Artificial Sequence: Synthetic oligonucleotide
  Target: FXN; (-) strand; PAM type: YTN; PAM sequence: TTT
ttttttcttttttttagaga

SEQ ID NO: 24912 - DNA, 20 bp, Artificial Sequence
  Description of Artificial Sequence: Synthetic oligonucleotide
  Target: FXN; (-) strand; PAM type: YTN; PAM sequence: TTT
tttttttcttttttttagag

SEQ ID NO: 24913 - DNA, 20 bp, Artificial Sequence
  Description of Artificial Sequence: Synthetic oligonucleotide
  Target: FXN; (-) strand; PAM type: YTN; PAM sequence: CTT
ttttttttcttttttttaga

SEQ ID NO: 24914 - DNA, 20 bp, Artificial Sequence
  Description of Artificial Sequence: Synthetic oligonucleotide
  Target: FXN; (-) strand; PAM type: YTN; PAM sequence: CTA
aggccttttttttttctttt

SEQ ID NO: 24915 - DNA, 20 bp, Artificial Sequence
  Description of Artificial Sequence: Synthetic oligonucleotide
  Target: FXN; (-) strand; PAM type: YTN; PAM sequence: CTG
cacaaacgtggaaagtcaaa

SEQ ID NO: 24916 - DNA, 20 bp, Artificial Sequence
  Description of Artificial Sequence: Synthetic oligonucleotide
  Target: FXN; (-) strand; PAM type: YTN; PAM sequence: TTG
gagataaaaggctgcacaaa

SEQ ID NO: 24917 - DNA, 20 bp, Artificial Sequence
  Description of Artificial Sequence: Synthetic oligonucleotide
  Target: FXN; (-) strand; PAM type: YTN; PAM sequence: TTA
gtagatgtgacaagaaaaga

SEQ ID NO: 24918 - DNA, 20 bp, Artificial Sequence
  Description of Artificial Sequence: Synthetic oligonucleotide
  Target: FXN; (-) strand; PAM type: YTN; PAM sequence: TTT
agtagatgtgacaagaaaag

SEQ ID NO: 24919 - DNA, 20 bp, Artificial Sequence
  Description of Artificial Sequence: Synthetic oligonucleotide
  Target: FXN; (-) strand; PAM type: YTN; PAM sequence: TTT
tagtagatgtgacaagaaaa

SEQ ID NO: 24920 - DNA, 20 bp, Artificial Sequence
  Description of Artificial Sequence: Synthetic oligonucleotide
  Target: FXN; (-) strand; PAM type: YTN; PAM sequence: CTT
ttagtagatgtgacaagaaa

SEQ ID NO: 24921 - DNA, 20 bp, Artificial Sequence
  Description of Artificial Sequence: Synthetic oligonucleotide
  Target: FXN; (-) strand; PAM type: YTN; PAM sequence: TTG
cttttagtagatgtgacaag

SEQ ID NO: 24922 - DNA, 20 bp, Artificial Sequence
  Description of Artificial Sequence: Synthetic oligonucleotide
  Target: FXN; (-) strand; PAM type: YTN; PAM sequence: TTG
ttgcttttagtagatgtgac

SEQ ID NO: 24923 - DNA, 20 bp, Artificial Sequence
  Description of Artificial Sequence: Synthetic oligonucleotide
  Target: FXN; (-) strand; PAM type: YTN; PAM sequence: CTT
gttgcttttagtagatgtga

SEQ ID NO: 24924 - DNA, 20 bp, Artificial Sequence
  Description of Artificial Sequence: Synthetic oligonucleotide
  Target: FXN; (-) strand; PAM type: YTN; PAM sequence: TTC
ttgttgcttttagtagatgt

SEQ ID NO: 24925 - DNA, 20 bp, Artificial Sequence
  Description of Artificial Sequence: Synthetic oligonucleotide
  Target: FXN; (-) strand; PAM type: YTN; PAM sequence: CTT
cttgttgcttttagtagatg

SEQ ID NO: 24926 - DNA, 20 bp, Artificial Sequence
  Description of Artificial Sequence: Synthetic oligonucleotide
  Target: FXN; (-) strand; PAM type: YTN; PAM sequence: CTG
aataccggtggcttcttgtt

SEQ ID NO: 24927 - DNA, 20 bp, Artificial Sequence
  Description of Artificial Sequence: Synthetic oligonucleotide
  Target: FXN; (-) strand; PAM type: YTN; PAM sequence: TTC
ctgaataccggtggcttctt

SEQ ID NO: 24928 - DNA, 20 bp, Artificial Sequence
  Description of Artificial Sequence: Synthetic oligonucleotide
  Target: FXN; (-) strand; PAM type: YTN; PAM sequence: CTG
gggacaggtagaatgttcct

SEQ ID NO: 24929 - DNA, 20 bp, Artificial Sequence
  Description of Artificial Sequence: Synthetic oligonucleotide
  Target: FXN; (-) strand; PAM type: YTN; PAM sequence: CTC
tggggacaggtagaatgttc

SEQ ID NO: 24930 - DNA, 20 bp, Artificial Sequence
  Description of Artificial Sequence: Synthetic oligonucleotide
  Target: FXN; (-) strand; PAM type: YTN; PAM sequence: CTG
agcatatagctctggggaca

SEQ ID NO: 24931 - DNA, 20 bp, Artificial Sequence
  Description of Artificial Sequence: Synthetic oligonucleotide
  Target: FXN; (-) strand; PAM type: YTN; PAM sequence: CTA
ctgagcatatagctctgggg

SEQ ID NO: 24932 - DNA, 20 bp, Artificial Sequence
  Description of Artificial Sequence: Synthetic oligonucleotide
  Target: FXN; (-) strand; PAM type: YTN; PAM sequence: CTG
tatgcctactgagcatatag

SEQ ID NO: 24933 - DNA, 20 bp, Artificial Sequence
  Description of Artificial Sequence: Synthetic oligonucleotide
  Target: FXN; (-) strand; PAM type: YTN; PAM sequence: CTG
gagggccaactgtatgccta

SEQ ID NO: 24934 - DNA, 20 bp, Artificial Sequence
  Description of Artificial Sequence: Synthetic oligonucleotide
  Target: FXN; (-) strand; PAM type: YTN; PAM sequence: CTC
agataacctggagggccaac

SEQ ID NO: 24935 - DNA, 20 bp, Artificial Sequence
  Description of Artificial Sequence: Synthetic oligonucleotide
  Target: FXN; (-) strand; PAM type: YTN; PAM sequence: CTG
agtctcagataacctggagg

SEQ ID NO: 24936 - DNA, 20 bp, Artificial Sequence
  Description of Artificial Sequence: Synthetic oligonucleotide
  Target: FXN; (-) strand; PAM type: YTN; PAM sequence: CTG
gaaatctgagtctcagataa

SEQ ID NO: 24937 - DNA, 20 bp, Artificial Sequence
  Description of Artificial Sequence: Synthetic oligonucleotide
  Target: FXN; (-) strand; PAM type: YTN; PAM sequence: CTC
tggaaatctgagtctcagat

SEQ ID NO: 24938 - DNA, 20 bp, Artificial Sequence
  Description of Artificial Sequence: Synthetic oligonucleotide
  Target: FXN; (-) strand; PAM type: YTN; PAM sequence: TTG
tgagccatgcaaagccctct

SEQ ID NO: 24939 - DNA, 20 bp, Artificial Sequence
  Description of Artificial Sequence: Synthetic oligonucleotide
  Target: FXN; (-) strand; PAM type: YTN; PAM sequence: CTT
gtgagccatgcaaagccctc

SEQ ID NO: 24940 - DNA, 20 bp, Artificial Sequence
  Description of Artificial Sequence: Synthetic oligonucleotide
  Target: FXN; (-) strand; PAM type: YTN; PAM sequence: TTC
agaccttgtgagccatgcaa

SEQ ID NO: 24941 - DNA, 20 bp, Artificial Sequence
  Description of Artificial Sequence: Synthetic oligonucleotide
  Target: FXN; (-) strand; PAM type: YTN; PAM sequence: CTT
cagaccttgtgagccatgca

SEQ ID NO: 24942 - DNA, 20 bp, Artificial Sequence
  Description of Artificial Sequence: Synthetic oligonucleotide
  Target: FXN; (-) strand; PAM type: YTN; PAM sequence: TTC
ttcagaccttgtgagccatg

SEQ ID NO: 24943 - DNA, 20 bp, Artificial Sequence
  Description of Artificial Sequence: Synthetic oligonucleotide
  Target: FXN; (-) strand; PAM type: YTN; PAM sequence: CTC
agaggttcttcagaccttgt

SEQ ID NO: 24944 - DNA, 20 bp, Artificial Sequence
  Description of Artificial Sequence: Synthetic oligonucleotide
  Target: FXN; (-) strand; PAM type: YTN; PAM sequence: CTG
tggcaaagtcaatgaacaga

SEQ ID NO: 24945 - DNA, 20 bp, Artificial Sequence
  Description of Artificial Sequence: Synthetic oligonucleotide
  Target: FXN; (-) strand; PAM type: YTN; PAM sequence: TTG
agactgtggcaaagtcaatg

SEQ ID NO: 24946 - DNA, 20 bp, Artificial Sequence
  Description of Artificial Sequence: Synthetic oligonucleotide
  Target: FXN; (-) strand; PAM type: YTN; PAM sequence: TTT
gagactgtggcaaagtcaat

SEQ ID NO: 24947 - DNA, 20 bp, Artificial Sequence
  Description of Artificial Sequence: Synthetic oligonucleotide
  Target: FXN; (-) strand; PAM type: YTN; PAM sequence: CTT
tgagactgtggcaaagtcaa

SEQ ID NO: 24948 - DNA, 20 bp, Artificial Sequence
  Description of Artificial Sequence: Synthetic oligonucleotide
  Target: FXN; (-) strand; PAM type: YTN; PAM sequence: CTC
tttgagactgtggcaaagtc

SEQ ID NO: 24949 - DNA, 20 bp, Artificial Sequence
  Description of Artificial Sequence: Synthetic oligonucleotide
  Target: FXN; (-) strand; PAM type: YTN; PAM sequence: CTC
aaacatgcagcatgcagtgc

SEQ ID NO: 24950 - DNA, 20 bp, Artificial Sequence
  Description of Artificial Sequence: Synthetic oligonucleotide
  Target: FXN; (-) strand; PAM type: YTN; PAM sequence: CTG
gaaatggatgccaccaaagc

SEQ ID NO: 24951 - DNA, 20 bp, Artificial Sequence
  Description of Artificial Sequence: Synthetic oligonucleotide
  Target: FXN; (-) strand; PAM type: YTN; PAM sequence: CTG
ggggaggaatgccggaagcc

SEQ ID NO: 24952 - DNA, 20 bp, Artificial Sequence
  Description of Artificial Sequence: Synthetic oligonucleotide
  Target: FXN; (-) strand; PAM type: YTN; PAM sequence: CTG
ctgggggaggaatgccggaa

SEQ ID NO: 24953 - DNA, 20 bp, Artificial Sequence
  Description of Artificial Sequence: Synthetic oligonucleotide
  Target: FXN; (-) strand; PAM type: YTN; PAM sequence: CTG
ccagaaggagtaaggggaaa

SEQ ID NO: 24954 - DNA, 20 bp, Artificial Sequence
  Description of Artificial Sequence: Synthetic oligonucleotide
  Target: FXN; (-) strand; PAM type: YTN; PAM sequence: CTC
ccagaactgccagaaggagt

SEQ ID NO: 24955 - DNA, 20 bp, Artificial Sequence
  Description of Artificial Sequence: Synthetic oligonucleotide
  Target: FXN; (-) strand; PAM type: YTN; PAM sequence: CTA
tgcaacctcccagaactgcc

SEQ ID NO: 24956 - DNA, 20 bp, Artificial Sequence
  Description of Artificial Sequence: Synthetic oligonucleotide
  Target: FXN; (-) strand; PAM type: YTN; PAM sequence: CTG
caagggccctatgcaacctc

SEQ ID NO: 24957 - DNA, 20 bp, Artificial Sequence
  Description of Artificial Sequence: Synthetic oligonucleotide
  Target: FXN; (-) strand; PAM type: YTN; PAM sequence: TTG
gggcatcctgcaagggccct

SEQ ID NO: 24958 - DNA, 20 bp, Artificial Sequence
  Description of Artificial Sequence: Synthetic oligonucleotide
  Target: FXN; (-) strand; PAM type: YTN; PAM sequence: CTT
ggggcatcctgcaagggccc

SEQ ID NO: 24959 - DNA, 20 bp, Artificial Sequence
  Description of Artificial Sequence: Synthetic oligonucleotide
  Target: FXN; (-) strand; PAM type: YTN; PAM sequence: CTG
gacttggggcatcctgcaag

SEQ ID NO: 24960 - DNA, 20 bp, Artificial Sequence
  Description of Artificial Sequence: Synthetic oligonucleotide
  Target: FXN; (-) strand; PAM type: YTN; PAM sequence: TTC
ccagaggccagaggcagctg

SEQ ID NO: 24961 - DNA, 20 bp, Artificial Sequence
  Description of Artificial Sequence: Synthetic oligonucleotide
  Target: FXN; (-) strand; PAM type: YTN; PAM sequence: CTT
cccagaggccagaggcagct

SEQ ID NO: 24962 - DNA, 20 bp, Artificial Sequence
  Description of Artificial Sequence: Synthetic oligonucleotide
  Target: FXN; (-) strand; PAM type: YTN; PAM sequence: CTA
cacatggcaggtcaagggtg

SEQ ID NO: 24963 - DNA, 20 bp, Artificial Sequence
  Description of Artificial Sequence: Synthetic oligonucleotide
  Target: FXN; (-) strand; PAM type: YTN; PAM sequence: TTC
ctacacatggcaggtcaagg

SEQ ID NO: 24964 - DNA, 20 bp, Artificial Sequence
  Description of Artificial Sequence: Synthetic oligonucleotide
  Target: FXN; (-) strand; PAM type: YTN; PAM sequence: CTT
cctacacatggcaggtcaag

SEQ ID NO: 24965 - DNA, 20 bp, Artificial Sequence
  Description of Artificial Sequence: Synthetic oligonucleotide
  Target: FXN; (-) strand; PAM type: YTN; PAM sequence: CTG
tcttcctacacatggcaggt

SEQ ID NO: 24966 - DNA, 20 bp, Artificial Sequence
  Description of Artificial Sequence: Synthetic oligonucleotide
  Target: FXN; (-) strand; PAM type: YTN; PAM sequence: CTG
gcagaagcgggctgtcttcc

SEQ ID NO: 24967 - DNA, 20 bp, Artificial Sequence
  Description of Artificial Sequence: Synthetic oligonucleotide
  Target: FXN; (-) strand; PAM type: YTN; PAM sequence: TTG
ggccctggcagaagcgggct

SEQ ID NO: 24968 - DNA, 20 bp, Artificial Sequence
  Description of Artificial Sequence: Synthetic oligonucleotide
  Target: FXN; (-) strand; PAM type: YTN; PAM sequence: CTG
ccggcagagttgggccctgg

SEQ ID NO: 24969 - DNA, 20 bp, Artificial Sequence
  Description of Artificial Sequence: Synthetic oligonucleotide
  Target: FXN; (-) strand; PAM type: YTN; PAM sequence: CTA
cctgccggcagagttgggcc

SEQ ID NO: 24970 - DNA, 20 bp, Artificial Sequence
  Description of Artificial Sequence: Synthetic oligonucleotide
  Target: FXN; (-) strand; PAM type: YTN; PAM sequence: TTG
gaaggtgctacctgccggca

SEQ ID NO: 24971 - DNA, 20 bp, Artificial Sequence
  Description of Artificial Sequence: Synthetic oligonucleotide
  Target: FXN; (-) strand; PAM type: YTN; PAM sequence: TTA
taaagtccaaagtgaagagg

SEQ ID NO: 24972 - DNA, 20 bp, Artificial Sequence
  Description of Artificial Sequence: Synthetic oligonucleotide
  Target: FXN; (-) strand; PAM type: YTN; PAM sequence: CTG
acagttataaagtccaaagt

SEQ ID NO: 24973 - DNA, 20 bp, Artificial Sequence
  Description of Artificial Sequence: Synthetic oligonucleotide
  Target: FXN; (-) strand; PAM type: YTN; PAM sequence: TTA
tacctgacagttataaagtc

SEQ ID NO: 24974 - DNA, 20 bp, Artificial Sequence
  Description of Artificial Sequence: Synthetic oligonucleotide
  Target: FXN; (-) strand; PAM type: YTN; PAM sequence: TTT
atacctgacagttataaagt

SEQ ID NO: 24975 - DNA, 20 bp, Artificial Sequence
  Description of Artificial Sequence: Synthetic oligonucleotide
  Target: FXN; (-) strand; PAM type: YTN; PAM sequence: CTT
tatacctgacagttataaag

SEQ ID NO: 24976 - DNA, 20 bp, Artificial Sequence
  Description of Artificial Sequence: Synthetic oligonucleotide
  Target: FXN; (-) strand; PAM type: YTN; PAM sequence: TTG
agaaacgtaaggacacaacc

SEQ ID NO: 24977 - DNA, 20 bp, Artificial Sequence
  Description of Artificial Sequence: Synthetic oligonucleotide
  Target: FXN; (-) strand; PAM type: YTN; PAM sequence: TTT
gagaaacgtaaggacacaac

SEQ ID NO: 24978 - DNA, 20 bp, Artificial Sequence
  Description of Artificial Sequence: Synthetic oligonucleotide
  Target: FXN; (-) strand; PAM type: YTN; PAM sequence: TTG
aagaatttgagaaacgtaag

SEQ ID NO: 24979 - DNA, 20 bp, Artificial Sequence
  Description of Artificial Sequence: Synthetic oligonucleotide
  Target: FXN; (-) strand; PAM type: YTN; PAM sequence: CTT
gaagaatttgagaaacgtaa

SEQ ID NO: 24980 - DNA, 20 bp, Artificial Sequence
  Description of Artificial Sequence: Synthetic oligonucleotide
  Target: FXN; (-) strand; PAM type: YTN; PAM sequence: TTG
acgtgtcttgaagaatttga

SEQ ID NO: 24981 - DNA, 20 bp, Artificial Sequence
  Description of Artificial Sequence: Synthetic oligonucleotide
  Target: FXN; (-) strand; PAM type: YTN; PAM sequence: CTG
gttgacgtgtcttgaagaat

SEQ ID NO: 24982 - DNA, 20 bp, Artificial Sequence
  Description of Artificial Sequence: Synthetic oligonucleotide
  Target: FXN; (-) strand; PAM type: YTN; PAM sequence: CTG
gagagaatgcgtaggagagg

SEQ ID NO: 24983 - DNA, 20 bp, Artificial Sequence
  Description of Artificial Sequence: Synthetic oligonucleotide
  Target: FXN; (-) strand; PAM type: YTN; PAM sequence: CTG
agctggagagaatgcgtagg

SEQ ID NO: 24984 - DNA, 20 bp, Artificial Sequence
  Description of Artificial Sequence: Synthetic oligonucleotide
  Target: FXN; (-) strand; PAM type: YTN; PAM sequence: TTG
agactgagctggagagaatg

SEQ ID NO: 24985 - DNA, 20 bp, Artificial Sequence
  Description of Artificial Sequence: Synthetic oligonucleotide
  Target: FXN; (-) strand; PAM type: YTN; PAM sequence: TTT
gagactgagctggagagaat

SEQ ID NO: 24986 - DNA, 20 bp, Artificial Sequence
  Description of Artificial Sequence: Synthetic oligonucleotide
  Target: FXN; (-) strand; PAM type: YTN; PAM sequence: TTT
tgagactgagctggagagaa

SEQ ID NO: 24987 - DNA, 20 bp, Artificial Sequence
  Description of Artificial Sequence: Synthetic oligonucleotide
  Target: FXN; (-) strand; PAM type: YTN; PAM sequence: CTG
gagagaaagggtgtgttttg

SEQ ID NO: 24988 - DNA, 20 bp, Artificial Sequence
  Description of Artificial Sequence: Synthetic oligonucleotide
  Target: FXN; (-) strand; PAM type: YTN; PAM sequence: TTG
agagtgagctggagagaaag

SEQ ID NO: 24989 - DNA, 20 bp, Artificial Sequence
  Description of Artificial Sequence: Synthetic oligonucleotide
  Target: FXN; (-) strand; PAM type: YTN; PAM sequence: TTT
gagagtgagctggagagaaa

SEQ ID NO: 24990 - DNA, 20 bp, Artificial Sequence
  Description of Artificial Sequence: Synthetic oligonucleotide
  Target: FXN; (-) strand; PAM type: YTN; PAM sequence: TTT
tgagagtgagctggagagaa

SEQ ID NO: 24991 - DNA, 20 bp, Artificial Sequence
  Description of Artificial Sequence: Synthetic oligonucleotide
  Target: FXN; (-) strand; PAM type: YTN; PAM sequence: CTG
atagggtgtgttttgagagt

SEQ ID NO: 24992 - DNA, 20 bp, Artificial Sequence
  Description of Artificial Sequence: Synthetic oligonucleotide
  Target: FXN; (-) strand; PAM type: YTN; PAM sequence: TTG
gcctgatagggtgtgttttg

SEQ ID NO: 24993 - DNA, 20 bp, Artificial Sequence
  Description of Artificial Sequence: Synthetic oligonucleotide
  Target: FXN; (-) strand; PAM type: YTN; PAM sequence: TTA
aaaagagtggttggcctgat

SEQ ID NO: 24994 - DNA, 20 bp, Artificial Sequence
  Description of Artificial Sequence: Synthetic oligonucleotide
  Target: FXN; (-) strand; PAM type: YTN; PAM sequence: TTT
aaaaagagtggttggcctga

SEQ ID NO: 24995 - DNA, 20 bp, Artificial Sequence
  Description of Artificial Sequence: Synthetic oligonucleotide
  Target: FXN; (-) strand; PAM type: YTN; PAM sequence: CTT
taaaaagagtggttggcctg

SEQ ID NO: 24996 - DNA, 20 bp, Artificial Sequence
  Description of Artificial Sequence: Synthetic oligonucleotide
  Target: FXN; (-) strand; PAM type: YTN; PAM sequence: CTG
tcctttaaaaagagtggttg

SEQ ID NO: 24997 - DNA, 20 bp, Artificial Sequence
  Description of Artificial Sequence: Synthetic oligonucleotide
  Target: FXN; (-) strand; PAM type: YTN; PAM sequence: TTG
gtgaggagctgtcctttaaa

SEQ ID NO: 24998 - DNA, 20 bp, Artificial Sequence
  Description of Artificial Sequence: Synthetic oligonucleotide
  Target: FXN; (-) strand; PAM type: YTN; PAM sequence: CTG
gattggtgaggagctgtcct

SEQ ID NO: 24999 - DNA, 20 bp, Artificial Sequence
  Description of Artificial Sequence: Synthetic oligonucleotide
  Target: FXN; (-) strand; PAM type: YTN; PAM sequence: CTG
actggattggtgaggagctg

SEQ ID NO: 25000 - DNA, 20 bp, Artificial Sequence
  Description of Artificial Sequence: Synthetic oligonucleotide
  Target: FXN; (-) strand; PAM type: YTN; PAM sequence: CTA
cctgactggattggtgagga

SEQ ID NO: 25001 - DNA, 20 bp, Artificial Sequence
  Description of Artificial Sequence: Synthetic oligonucleotide
  Target: FXN; (-) strand; PAM type: YTN; PAM sequence: TTC
caggatacaatgtggggaag

SEQ ID NO: 25002 - DNA, 20 bp, Artificial Sequence
  Description of Artificial Sequence: Synthetic oligonucleotide
  Target: FXN; (-) strand; PAM type: YTN; PAM sequence: CTT
ccaggatacaatgtggggaa

SEQ ID NO: 25003 - DNA, 20 bp, Artificial Sequence
  Description of Artificial Sequence: Synthetic oligonucleotide
  Target: FXN; (-) strand; PAM type: YTN; PAM sequence: TTC
cccacccagtccatcaccca

SEQ ID NO: 25004 - DNA, 20 bp, Artificial Sequence
  Description of Artificial Sequence: Synthetic oligonucleotide
  Target: FXN; (-) strand; PAM type: YTN; PAM sequence: CTT
ccccacccagtccatcaccc

SEQ ID NO: 25005 - DNA, 20 bp, Artificial Sequence
  Description of Artificial Sequence: Synthetic oligonucleotide
  Target: FXN; (-) strand; PAM type: YTN; PAM sequence: CTC
ttccccacccagtccatcac

SEQ ID NO: 25006 - DNA, 20 bp, Artificial Sequence
  Description of Artificial Sequence: Synthetic oligonucleotide
  Target: FXN; (-) strand; PAM type: YTN; PAM sequence: TTG
ccatatgaccctcttcccca

SEQ ID NO: 25007 - DNA, 20 bp, Artificial Sequence
  Description of Artificial Sequence: Synthetic oligonucleotide
  Target: FXN; (-) strand; PAM type: YTN; PAM sequence: TTT
gccatatgaccctcttcccc

SEQ ID NO: 25008 - DNA, 20 bp, Artificial Sequence
  Description of Artificial Sequence: Synthetic oligonucleotide
  Target: FXN; (-) strand; PAM type: YTN; PAM sequence: CTG
taagacatacagatttgcca

SEQ ID NO: 25009 - DNA, 20 bp, Artificial Sequence
  Description of Artificial Sequence: Synthetic oligonucleotide
  Target: FXN; (-) strand; PAM type: YTN; PAM sequence: TTA
ctgtaagacatacagatttg

SEQ ID NO: 25010 - DNA, 20 bp, Artificial Sequence
  Description of Artificial Sequence: Synthetic oligonucleotide
  Target: FXN; (-) strand; PAM type: YTN; PAM sequence: CTA
gacaattactgtaagacata

SEQ ID NO: 25011 - DNA, 20 bp, Artificial Sequence
  Description of Artificial Sequence: Synthetic oligonucleotide
  Target: FXN; (-) strand; PAM type: YTN; PAM sequence: CTG
ctagacaattactgtaagac

SEQ ID NO: 25012 - DNA, 20 bp, Artificial Sequence
  Description of Artificial Sequence: Synthetic oligonucleotide
  Target: FXN; (-) strand; PAM type: YTN; PAM sequence: CTA
aagtaagacaccaggggctg

SEQ ID NO: 25013 - DNA, 20 bp, Artificial Sequence
  Description of Artificial Sequence: Synthetic oligonucleotide
  Target: FXN; (-) strand; PAM type: YTN; PAM sequence: TTC
cagggggcctaaagtaagac

SEQ ID NO: 25014 - DNA, 20 bp, Artificial Sequence
  Description of Artificial Sequence: Synthetic oligonucleotide
  Target: FXN; (-) strand; PAM type: YTN; PAM sequence: TTT
ccagggggcctaaagtaaga

SEQ ID NO: 25015 - DNA, 20 bp, Artificial Sequence
  Description of Artificial Sequence: Synthetic oligonucleotide
  Target: FXN; (-) strand; PAM type: YTN; PAM sequence: CTG
aaagtttccagggggcctaa

SEQ ID NO: 25016 - DNA, 20 bp, Artificial Sequence
  Description of Artificial Sequence: Synthetic oligonucleotide
  Target: FXN; (-) strand; PAM type: YTN; PAM sequence: CTA
tctgaaagtttccagggggc

SEQ ID NO: 25017 - DNA, 20 bp, Artificial Sequence
  Description of Artificial Sequence: Synthetic oligonucleotide
  Target: FXN; (-) strand; PAM type: YTN; PAM sequence: CTC
cactatctgaaagtttccag

SEQ ID NO: 25018 - DNA, 20 bp, Artificial Sequence
  Description of Artificial Sequence: Synthetic oligonucleotide
  Target: FXN; (-) strand; PAM type: YTN; PAM sequence: TTA
taagatatgtatcagacaac

SEQ ID NO: 25019 - DNA, 20 bp, Artificial Sequence
  Description of Artificial Sequence: Synthetic oligonucleotide
  Target: FXN; (-) strand; PAM type: YTN; PAM sequence: CTG
taggttataagatatgtatc

SEQ ID NO: 25020 - DNA, 20 bp, Artificial Sequence
  Description of Artificial Sequence: Synthetic oligonucleotide
  Target: FXN; (-) strand; PAM type: YTN; PAM sequence: TTA
atatctgtaggttataagat

SEQ ID NO: 25021 - DNA, 20 bp, Artificial Sequence
  Description of Artificial Sequence: Synthetic oligonucleotide
  Target: FXN; (-) strand; PAM type: YTN; PAM sequence: CTG
tgaggatatattaatatctg

SEQ ID NO: 25022 - DNA, 20 bp, Artificial Sequence
  Description of Artificial Sequence: Synthetic oligonucleotide
  Target: FXN; (-) strand; PAM type: YTN; PAM sequence: TTG
tgcccctgtgaggatatatt

SEQ ID NO: 25023 - DNA, 20 bp, Artificial Sequence
  Description of Artificial Sequence: Synthetic oligonucleotide
  Target: FXN; (-) strand; PAM type: YTN; PAM sequence: TTT
gtgcccctgtgaggatatat

SEQ ID NO: 25024 - DNA, 20 bp, Artificial Sequence
  Description of Artificial Sequence: Synthetic oligonucleotide
  Target: FXN; (-) strand; PAM type: YTN; PAM sequence: TTT
tgtgcccctgtgaggatata

SEQ ID NO: 25025 - DNA, 20 bp, Artificial Sequence
  Description of Artificial Sequence: Synthetic oligonucleotide
  Target: FXN; (-) strand; PAM type: YTN; PAM sequence: CTT
ttgtgcccctgtgaggatat

SEQ ID NO: 25026 - DNA, 20 bp, Artificial Sequence
  Description of Artificial Sequence: Synthetic oligonucleotide
  Target: FXN; (-) strand; PAM type: YTN; PAM sequence: TTG
taagagcttttgtgcccctg

SEQ ID NO: 25027 - DNA, 20 bp, Artificial Sequence
  Description of Artificial Sequence: Synthetic oligonucleotide
  Target: FXN; (-) strand; PAM type: YTN; PAM sequence: CTT
gtaagagcttttgtgcccct

SEQ ID NO: 25028 - DNA, 20 bp, Artificial Sequence
  Description of Artificial Sequence: Synthetic oligonucleotide
  Target: FXN; (-) strand; PAM type: YTN; PAM sequence: TTA
taataaacatccttgtaaga

SEQ ID NO: 25029 - DNA, 20 bp, Artificial Sequence
  Description of Artificial Sequence: Synthetic oligonucleotide
  Target: FXN; (-) strand; PAM type: YTN; PAM sequence: TTA
ttataataaacatccttgta

SEQ ID NO: 25030 - DNA, 20 bp, Artificial Sequence
  Description of Artificial Sequence: Synthetic oligonucleotide
  Target: FXN; (-) strand; PAM type: YTN; PAM sequence: TTA
taacaataaaaatattatta

SEQ ID NO: 25031 - DNA, 20 bp, Artificial Sequence
  Description of Artificial Sequence: Synthetic oligonucleotide
  Target: FXN; (-) strand; PAM type: YTN; PAM sequence: TTA
tggcatgtaaattataacaa

SEQ ID NO: 25032 - DNA, 20 bp, Artificial Sequence
  Description of Artificial Sequence: Synthetic oligonucleotide
  Target: FXN; (-) strand; PAM type: YTN; PAM sequence: TTT
atggcatgtaaattataaca

SEQ ID NO: 25033 - DNA, 20 bp, Artificial Sequence
  Description of Artificial Sequence: Synthetic oligonucleotide
  Target: FXN; (-) strand; PAM type: YTN; PAM sequence: TTT
tatggcatgtaaattataac

SEQ ID NO: 25034 - DNA, 20 bp, Artificial Sequence
  Description of Artificial Sequence: Synthetic oligonucleotide
  Target: FXN; (-) strand; PAM type: YTN; PAM sequence: TTA
gttttatggcatgtaaatta

SEQ ID NO: 25035 - DNA, 20 bp, Artificial Sequence
  Description of Artificial Sequence: Synthetic oligonucleotide
  Target: FXN; (-) strand; PAM type: YTN; PAM sequence: TTA
aaatggttagttttatggca

SEQ ID NO: 25036 - DNA, 20 bp, Artificial Sequence
  Description of Artificial Sequence: Synthetic oligonucleotide
  Target: FXN; (-) strand; PAM type: YTN; PAM sequence: TTT
aaaatggttagttttatggc

SEQ ID NO: 25037 - DNA, 20 bp, Artificial Sequence
  Description of Artificial Sequence: Synthetic oligonucleotide
  Target: FXN; (-) strand; PAM type: YTN; PAM sequence: TTT
taaaatggttagttttatgg

SEQ ID NO: 25038 - DNA, 20 bp, Artificial Sequence
  Description of Artificial Sequence: Synthetic oligonucleotide
  Target: FXN; (-) strand; PAM type: YTN; PAM sequence: TTA
tacattttaaaatggttagt

SEQ ID NO: 25039 - DNA, 20 bp, Artificial Sequence
  Description of Artificial Sequence: Synthetic oligonucleotide
  Target: FXN; (-) strand; PAM type: YTN; PAM sequence: TTG
cattatacattttaaaatgg

SEQ ID NO: 25040 - DNA, 20 bp, Artificial Sequence
  Description of Artificial Sequence: Synthetic oligonucleotide
  Target: FXN; (-) strand; PAM type: YTN; PAM sequence: CTT
gcattatacattttaaaatg

SEQ ID NO: 25041 - DNA, 20 bp, Artificial Sequence
  Description of Artificial Sequence: Synthetic oligonucleotide
  Target: FXN; (-) strand; PAM type: YTN; PAM sequence: CTA
aaaacccttgcattatacat

SEQ ID NO: 25042 - DNA, 20 bp, Artificial Sequence
  Description of Artificial Sequence: Synthetic oligonucleotide
  Target: FXN; (-) strand; PAM type: YTN; PAM sequence: TTG
tgaatatactaaaaaccctt

SEQ ID NO: 25043 - DNA, 20 bp, Artificial Sequence
  Description of Artificial Sequence: Synthetic oligonucleotide
  Target: FXN; (-) strand; PAM type: YTN; PAM sequence: CTT
gtgaatatactaaaaaccct

SEQ ID NO: 25044 - DNA, 20 bp, Artificial Sequence
  Description of Artificial Sequence: Synthetic oligonucleotide
  Target: FXN; (-) strand; PAM type: YTN; PAM sequence: CTG
cacaatcttgtgaatatact

SEQ ID NO: 25045 - DNA, 20 bp, Artificial Sequence
  Description of Artificial Sequence: Synthetic oligonucleotide
  Target: FXN; (-) strand; PAM type: YTN; PAM sequence: TTA
gtagtgacagctgcacaatc

SEQ ID NO: 25046 - DNA, 20 bp, Artificial Sequence
  Description of Artificial Sequence: Synthetic oligonucleotide
  Target: FXN; (-) strand; PAM type: YTN; PAM sequence: CTG
gaattagtagtgacagctgc

SEQ ID NO: 25047 - DNA, 20 bp, Artificial Sequence
  Description of Artificial Sequence: Synthetic oligonucleotide
  Target: FXN; (-) strand; PAM type: YTN; PAM sequence: TTC
tggaattagtagtgacagct

SEQ ID NO: 25048 - DNA, 20 bp, Artificial Sequence
  Description of Artificial Sequence: Synthetic oligonucleotide
  Target: FXN; (-) strand; PAM type: YTN; PAM sequence: CTG
gaataatgaaaatgttctgg

SEQ ID NO: 25049 - DNA, 20 bp, Artificial Sequence
  Description of Artificial Sequence: Synthetic oligonucleotide
  Target: FXN; (-) strand; PAM type: YTN; PAM sequence: TTC
tggaataatgaaaatgttct

SEQ ID NO: 25050 - DNA, 20 bp, Artificial Sequence
  Description of Artificial Sequence: Synthetic oligonucleotide
  Target: FXN; (-) strand; PAM type: YTN; PAM sequence: CTT
ctggaataatgaaaatgttc

SEQ ID NO: 25051 - DNA, 20 bp, Artificial Sequence
  Description of Artificial Sequence: Synthetic oligonucleotide
  Target: FXN; (-) strand; PAM type: YTN; PAM sequence: TTC
cttctggaataatgaaaatg

SEQ ID NO: 25052 - DNA, 20 bp, Artificial Sequence
  Description of Artificial Sequence: Synthetic oligonucleotide
  Target: FXN; (-) strand; PAM type: YTN; PAM sequence: TTT
ccttctggaataatgaaaat

SEQ ID NO: 25053 - DNA, 20 bp, Artificial Sequence
  Description of Artificial Sequence: Synthetic oligonucleotide
  Target: FXN; (-) strand; PAM type: YTN; PAM sequence: CTA
atatgaatagggtttccttc

SEQ ID NO: 25054 - DNA, 20 bp, Artificial Sequence
  Description of Artificial Sequence: Synthetic oligonucleotide
  Target: FXN; (-) strand; PAM type: YTN; PAM sequence: TTG
ctaatatgaatagggtttcc

SEQ ID NO: 25055 - DNA, 20 bp, Artificial Sequence
  Description of Artificial Sequence: Synthetic oligonucleotide
  Target: FXN; (-) strand; PAM type: YTN; PAM sequence: TTA
gggaaaggcggaatggggga

SEQ ID NO: 25056 - DNA, 20 bp, Artificial Sequence
  Description of Artificial Sequence: Synthetic oligonucleotide
  Target: FXN; (-) strand; PAM type: YTN; PAM sequence: TTT
agggaaaggcggaatggggg

SEQ ID NO: 25057 - DNA, 20 bp, Artificial Sequence
  Description of Artificial Sequence: Synthetic oligonucleotide
  Target: FXN; (-) strand; PAM type: YTN; PAM sequence: TTT
tagggaaaggcggaatgggg

SEQ ID NO: 25058 - DNA, 20 bp, Artificial Sequence
  Description of Artificial Sequence: Synthetic oligonucleotide
  Target: FXN; (-) strand; PAM type: YTN; PAM sequence: CTG
ggttttagggaaaggcggaa

SEQ ID NO: 25059 - DNA, 20 bp, Artificial Sequence
  Description of Artificial Sequence: Synthetic oligonucleotide
  Target: FXN; (-) strand; PAM type: YTN; PAM sequence: TTG
ctgggttttagggaaaggcg

SEQ ID NO: 25060 - DNA, 20 bp, Artificial Sequence
  Description of Artificial Sequence: Synthetic oligonucleotide
  Target: FXN; (-) strand; PAM type: YTN; PAM sequence: TTA
gtgattgctgggttttaggg

SEQ ID NO: 25061 - DNA, 20 bp, Artificial Sequence
  Description of Artificial Sequence: Synthetic oligonucleotide
  Target: FXN; (-) strand; PAM type: YTN; PAM sequence: TTA
aatccacagagacagaaagt

SEQ ID NO: 25062 - DNA, 20 bp, Artificial Sequence
  Description of Artificial Sequence: Synthetic oligonucleotide
  Target: FXN; (-) strand; PAM type: YTN; PAM sequence: TTT
aaatccacagagacagaaag

SEQ ID NO: 25063 - DNA, 20 bp, Artificial Sequence
  Description of Artificial Sequence: Synthetic oligonucleotide
  Target: FXN; (-) strand; PAM type: YTN; PAM sequence: CTT
taaatccacagagacagaaa

SEQ ID NO: 25064 - DNA, 20 bp, Artificial Sequence
  Description of Artificial Sequence: Synthetic oligonucleotide
  Target: FXN; (-) strand; PAM type: YTN; PAM sequence: TTA
ctttaaatccacagagacag

SEQ ID NO: 25065 - DNA, 20 bp, Artificial Sequence
  Description of Artificial Sequence: Synthetic oligonucleotide
  Target: FXN; (-) strand; PAM type: YTN; PAM sequence: TTA
aaattactttaaatccacag

SEQ ID NO: 25066 - DNA, 20 bp, Artificial Sequence
  Description of Artificial Sequence: Synthetic oligonucleotide
  Target: FXN; (-) strand; PAM type: YTN; PAM sequence: TTT
aaaattactttaaatccaca

SEQ ID NO: 25067 - DNA, 20 bp, Artificial Sequence
  Description of Artificial Sequence: Synthetic oligonucleotide
  Target: FXN; (-) strand; PAM type: YTN; PAM sequence: TTC
aaatttaaaattactttaaa

SEQ ID NO: 25068 - DNA, 20 bp, Artificial Sequence
  Description of Artificial Sequence: Synthetic oligonucleotide
  Target: FXN; (-) strand; PAM type: YTN; PAM sequence: TTT
caaatttaaaattactttaa

SEQ ID NO: 25069 - DNA, 20 bp, Artificial Sequence
  Description of Artificial Sequence: Synthetic oligonucleotide
  Target: FXN; (-) strand; PAM type: YTN; PAM sequence: TTT
tcaaatttaaaattacttta

SEQ ID NO: 25070 - DNA, 20 bp, Artificial Sequence
  Description of Artificial Sequence: Synthetic oligonucleotide
  Target: FXN; (-) strand; PAM type: YTN; PAM sequence: TTT
ttcaaatttaaaattacttt

SEQ ID NO: 25071 - DNA, 20 bp, Artificial Sequence
  Description of Artificial Sequence: Synthetic oligonucleotide
  Target: FXN; (-) strand; PAM type: YTN; PAM sequence: CTA
tttttcaaatttaaaattac

SEQ ID NO: 25072 - DNA, 20 bp, Artificial Sequence
  Description of Artificial Sequence: Synthetic oligonucleotide
  Target: FXN; (-) strand; PAM type: YTN; PAM sequence: TTA
tagatactatttttcaaatt

SEQ ID NO: 25073 - DNA, 20 bp, Artificial Sequence
  Description of Artificial Sequence: Synthetic oligonucleotide
  Target: FXN; (-) strand; PAM type: YTN; PAM sequence: CTT
atagatactatttttcaaat

SEQ ID NO: 25074 - DNA, 20 bp, Artificial Sequence
  Description of Artificial Sequence: Synthetic oligonucleotide
  Target: FXN; (-) strand; PAM type: YTN; PAM sequence: TTC
cttatagatactatttttca

SEQ ID NO: 25075 - DNA, 20 bp, Artificial Sequence
  Description of Artificial Sequence: Synthetic oligonucleotide
  Target: FXN; (-) strand; PAM type: YTN; PAM sequence: TTT
ccttatagatactatttttc

SEQ ID NO: 25076 - DNA, 20 bp, Artificial Sequence
  Description of Artificial Sequence: Synthetic oligonucleotide
  Target: FXN; (-) strand; PAM type: YTN; PAM sequence: CTA
gatacatttccttatagata

SEQ ID NO: 25077 - DNA, 20 bp, Artificial Sequence
  Description of Artificial Sequence: Synthetic oligonucleotide
  Target: FXN; (-) strand; PAM type: YTN; PAM sequence: TTG
tgactagatacatttcctta

SEQ ID NO: 25078 - DNA, 20 bp, Artificial Sequence
  Description of Artificial Sequence: Synthetic oligonucleotide
  Target: FXN; (-) strand; PAM type: YTN; PAM sequence: CTT
gtgactagatacatttcctt

SEQ ID NO: 25079 - DNA, 20 bp, Artificial Sequence
  Description of Artificial Sequence: Synthetic oligonucleotide
  Target: FXN; (-) strand; PAM type: YTN; PAM sequence: CTG
tatgcttgtgactagataca

SEQ ID NO: 25080 - DNA, 20 bp, Artificial Sequence
  Description of Artificial Sequence: Synthetic oligonucleotide
  Target: FXN; (-) strand; PAM type: YTN; PAM sequence: TTC
atcaagctgtatgcttgtga

SEQ ID NO: 25081 - DNA, 20 bp, Artificial Sequence
  Description of Artificial Sequence: Synthetic oligonucleotide
  Target: FXN; (-) strand; PAM type: YTN; PAM sequence: TTA
caaattcatcaagctgtatg

SEQ ID NO: 25082 - DNA, 20 bp, Artificial Sequence
  Description of Artificial Sequence: Synthetic oligonucleotide
  Target: FXN; (-) strand; PAM type: YTN; PAM sequence: TTT
acaaattcatcaagctgtat

SEQ ID NO: 25083 - DNA, 20 bp, Artificial Sequence
  Description of Artificial Sequence: Synthetic oligonucleotide
  Target: FXN; (-) strand; PAM type: YTN; PAM sequence: TTT
tacaaattcatcaagctgta

SEQ ID NO: 25084 - DNA, 20 bp, Artificial Sequence
  Description of Artificial Sequence: Synthetic oligonucleotide
  Target: FXN; (-) strand; PAM type: YTN; PAM sequence: TTT
ttacaaattcatcaagctgt

SEQ ID NO: 25085 - DNA, 20 bp, Artificial Sequence
  Description of Artificial Sequence: Synthetic oligonucleotide
  Target: FXN; (-) strand; PAM type: YTN; PAM sequence: TTC
aatttttacaaattcatcaa

SEQ ID NO: 25086 - DNA, 20 bp, Artificial Sequence
  Description of Artificial Sequence: Synthetic oligonucleotide
  Target: FXN; (-) strand; PAM type: YTN; PAM sequence: CTG
ttcaatttttacaaattcat

SEQ ID NO: 25087 - DNA, 20 bp, Artificial Sequence
  Description of Artificial Sequence: Synthetic oligonucleotide
  Target: FXN; (-) strand; PAM type: YTN; PAM sequence: TTC
ataggactgttcaattttta

SEQ ID NO: 25088 - DNA, 20 bp, Artificial Sequence
  Description of Artificial Sequence: Synthetic oligonucleotide
  Target: FXN; (-) strand; PAM type: YTN; PAM sequence: TTA
cagggtatgttcataggact

SEQ ID NO: 25089 - DNA, 20 bp, Artificial Sequence
  Description of Artificial Sequence: Synthetic oligonucleotide
  Target: FXN; (-) strand; PAM type: YTN; PAM sequence: CTT
acagggtatgttcataggac

SEQ ID NO: 25090 - DNA, 20 bp, Artificial Sequence
  Description of Artificial Sequence: Synthetic oligonucleotide
  Target: FXN; (-) strand; PAM type: YTN; PAM sequence: TTG
agcttacagggtatgttcat

SEQ ID NO: 25091 - DNA, 20 bp, Artificial Sequence
  Description of Artificial Sequence: Synthetic oligonucleotide
  Target: FXN; (-) strand; PAM type: YTN; PAM sequence: CTT
gagcttacagggtatgttca

SEQ ID NO: 25092 - DNA, 20 bp, Artificial Sequence
  Description of Artificial Sequence: Synthetic oligonucleotide
  Target: FXN; (-) strand; PAM type: YTN; PAM sequence: CTA
tgtcttgagcttacagggta

SEQ ID NO: 25093 - DNA, 20 bp, Artificial Sequence
  Description of Artificial Sequence: Synthetic oligonucleotide
  Target: FXN; (-) strand; PAM type: YTN; PAM sequence: TTC
tatgtcttgagcttacaggg

SEQ ID NO: 25094 - DNA, 20 bp, Artificial Sequence
  Description of Artificial Sequence: Synthetic oligonucleotide
  Target: FXN; (-) strand; PAM type: YTN; PAM sequence: CTG
gtaacattctatgtcttgag

SEQ ID NO: 25095 - DNA, 20 bp, Artificial Sequence
  Description of Artificial Sequence: Synthetic oligonucleotide
  Target: FXN; (-) strand; PAM type: YTN; PAM sequence: TTG
caggggctggtaacattcta

SEQ ID NO: 25096 - DNA, 20 bp, Artificial Sequence
  Description of Artificial Sequence: Synthetic oligonucleotide
  Target: FXN; (-) strand; PAM type: YTN; PAM sequence: CTT
gcaggggctggtaacattct

SEQ ID NO: 25097 - DNA, 20 bp, Artificial Sequence
  Description of Artificial Sequence: Synthetic oligonucleotide
  Target: FXN; (-) strand; PAM type: YTN; PAM sequence: TTG
cttgcaggggctggtaacat

SEQ ID NO: 25098 - DNA, 20 bp, Artificial Sequence
  Description of Artificial Sequence: Synthetic oligonucleotide
  Target: FXN; (-) strand; PAM type: YTN; PAM sequence: CTT
gcttgcaggggctggtaaca

SEQ ID NO: 25099 - DNA, 20 bp, Artificial Sequence
  Description of Artificial Sequence: Synthetic oligonucleotide
  Target: FXN; (-) strand; PAM type: YTN; PAM sequence: CTA
gaagtgagcaggcagcttgc

SEQ ID NO: 25100 - DNA, 20 bp, Artificial Sequence
  Description of Artificial Sequence: Synthetic oligonucleotide
  Target: FXN; (-) strand; PAM type: YTN; PAM sequence: TTA
atgactagaagtgagcaggc

SEQ ID NO: 25101 - DNA, 20 bp, Artificial Sequence
  Description of Artificial Sequence: Synthetic oligonucleotide
  Target: FXN; (-) strand; PAM type: YTN; PAM sequence: CTA
gaaggaaaagagggaggggt

SEQ ID NO: 25102 - DNA, 20 bp, Artificial Sequence
  Description of Artificial Sequence: Synthetic oligonucleotide
  Target: FXN; (-) strand; PAM type: YTN; PAM sequence: TTA
atgactagaaggaaaagagg

SEQ ID NO: 25103 - DNA, 20 bp, Artificial Sequence
  Description of Artificial Sequence: Synthetic oligonucleotide
  Target: FXN; (-) strand; PAM type: YTN; PAM sequence: CTG
aagggttaatgactagaagg

SEQ ID NO: 25104 - DNA, 20 bp, Artificial Sequence
  Description of Artificial Sequence: Synthetic oligonucleotide
  Target: FXN; (-) strand; PAM type: YTN; PAM sequence: CTC
tgaagggttaatgactagaa

SEQ ID NO: 25105 - DNA, 20 bp, Artificial Sequence
  Description of Artificial Sequence: Synthetic oligonucleotide
  Target: FXN; (-) strand; PAM type: YTN; PAM sequence: TTA
ctctgaagggttaatgacta

SEQ ID NO: 25106 - DNA, 20 bp, Artificial Sequence
  Description of Artificial Sequence: Synthetic oligonucleotide
  Target: FXN; (-) strand; PAM type: YTN; PAM sequence: TTG
gtaatcagaatagttactct

SEQ ID NO: 25107 - DNA, 20 bp, Artificial Sequence
  Description of Artificial Sequence: Synthetic oligonucleotide
  Target: FXN; (-) strand; PAM type: YTN; PAM sequence: CTA
ttggtaatcagaatagttac

SEQ ID NO: 25108 - DNA, 20 bp, Artificial Sequence
  Description of Artificial Sequence: Synthetic oligonucleotide
  Target: FXN; (-) strand; PAM type: YTN; PAM sequence: CTA
tgctattggtaatcagaata

SEQ ID NO: 25109 - DNA, 20 bp, Artificial Sequence
  Description of Artificial Sequence: Synthetic oligonucleotide
  Target: FXN; (-) strand; PAM type: YTN; PAM sequence: CTA
atctatgctattggtaatca

SEQ ID NO: 25110 - DNA, 20 bp, Artificial Sequence
  Description of Artificial Sequence: Synthetic oligonucleotide
  Target: FXN; (-) strand; PAM type: YTN; PAM sequence: TTA
tataaagtaaaacaacaggc

SEQ ID NO: 25111 - DNA, 20 bp, Artificial Sequence
  Description of Artificial Sequence: Synthetic oligonucleotide
  Target: FXN; (-) strand; PAM type: YTN; PAM sequence: TTT
atataaagtaaaacaacagg

SEQ ID NO: 25112 - DNA, 20 bp, Artificial Sequence
  Description of Artificial Sequence: Synthetic oligonucleotide
  Target: FXN; (-) strand; PAM type: YTN; PAM sequence: TTA
atgagacagtttatataaag

SEQ ID NO: 25113 - DNA, 20 bp, Artificial Sequence
  Description of Artificial Sequence: Synthetic oligonucleotide
  Target: FXN; (-) strand; PAM type: YTN; PAM sequence: CTT
aatgagacagtttatataaa

SEQ ID NO: 25114 - DNA, 20 bp, Artificial Sequence
  Description of Artificial Sequence: Synthetic oligonucleotide
  Target: FXN; (-) strand; PAM type: YTN; PAM sequence: TTA
tacttaatgagacagtttat

SEQ ID NO: 25115 - DNA, 20 bp, Artificial Sequence
  Description of Artificial Sequence: Synthetic oligonucleotide
  Target: FXN; (-) strand; PAM type: YTN; PAM sequence: TTT
atacttaatgagacagttta

SEQ ID NO: 25116 - DNA, 20 bp, Artificial Sequence
  Description of Artificial Sequence: Synthetic oligonucleotide
  Target: FXN; (-) strand; PAM type: YTN; PAM sequence: TTG
tgatagaaagaaatacacaa

SEQ ID NO: 25117 - DNA, 20 bp, Artificial Sequence
  Description of Artificial Sequence: Synthetic oligonucleotide
  Target: FXN; (-) strand; PAM type: YTN; PAM sequence: CTC
acaaacatcattgtgataga

SEQ ID NO: 25118 - DNA, 20 bp, Artificial Sequence
  Description of Artificial Sequence: Synthetic oligonucleotide
  Target: FXN; (-) strand; PAM type: YTN; PAM sequence: CTA
taggaacagcatggatgaat

SEQ ID NO: 25119 - DNA, 20 bp, Artificial Sequence
  Description of Artificial Sequence: Synthetic oligonucleotide
  Target: FXN; (-) strand; PAM type: YTN; PAM sequence: TTG
tctataggaacagcatggat

SEQ ID NO: 25120 - DNA, 20 bp, Artificial Sequence
  Description of Artificial Sequence: Synthetic oligonucleotide
  Target: FXN; (-) strand; PAM type: YTN; PAM sequence: CTG
caaaatagaattgtctatag

SEQ ID NO: 25121 - DNA, 20 bp, Artificial Sequence
  Description of Artificial Sequence: Synthetic oligonucleotide
  Target: FXN; (-) strand; PAM type: YTN; PAM sequence: CTA
cgctgcaaaatagaattgtc

SEQ ID NO: 25122 - DNA, 20 bp, Artificial Sequence
  Description of Artificial Sequence: Synthetic oligonucleotide
  Target: FXN; (-) strand; PAM type: YTN; PAM sequence: TTG
tggtatagtcatgcaatgga

SEQ ID NO: 25123 - DNA, 20 bp, Artificial Sequence
  Description of Artificial Sequence: Synthetic oligonucleotide
  Target: FXN; (-) strand; PAM type: YTN; PAM sequence: TTG
taatatcacagataaattgt

SEQ ID NO: 25124 - DNA, 20 bp, Artificial Sequence
  Description of Artificial Sequence: Synthetic oligonucleotide
  Target: FXN; (-) strand; PAM type: YTN; PAM sequence: TTT
gtaatatcacagataaattg

SEQ ID NO: 25125 - DNA, 20 bp, Artificial Sequence
  Description of Artificial Sequence: Synthetic oligonucleotide
  Target: FXN; (-) strand; PAM type: YTN; PAM sequence: CTT
tgtaatatcacagataaatt

SEQ ID NO: 25126 - DNA, 20 bp, Artificial Sequence
  Description of Artificial Sequence: Synthetic oligonucleotide
  Target: FXN; (-) strand; PAM type: YTN; PAM sequence: TTC
ctttgtaatatcacagataa

SEQ ID NO: 25127 - DNA, 20 bp, Artificial Sequence
  Description of Artificial Sequence: Synthetic oligonucleotide
  Target: FXN; (-) strand; PAM type: YTN; PAM sequence: CTG
cccaagtattcctttgtaat

SEQ ID NO: 25128 - DNA, 20 bp, Artificial Sequence
  Description of Artificial Sequence: Synthetic oligonucleotide
  Target: FXN; (-) strand; PAM type: YTN; PAM sequence: CTG
gaaactgcccaagtattcct

SEQ ID NO: 25129 - DNA, 20 bp, Artificial Sequence
  Description of Artificial Sequence: Synthetic oligonucleotide
  Target: FXN; (-) strand; PAM type: YTN; PAM sequence: CTA
tagccccaaactggaaactg

SEQ ID NO: 25130 - DNA, 20 bp, Artificial Sequence
  Description of Artificial Sequence: Synthetic oligonucleotide
  Target: FXN; (-) strand; PAM type: YTN; PAM sequence: CTA
tcctatagccccaaactgga

SEQ ID NO: 25131 - DNA, 20 bp, Artificial Sequence
  Description of Artificial Sequence: Synthetic oligonucleotide
  Target: FXN; (-) strand; PAM type: YTN; PAM sequence: TTG
tatcacaactatcctatagc

SEQ ID NO: 25132 - DNA, 20 bp, Artificial Sequence
  Description of Artificial Sequence: Synthetic oligonucleotide
  Target: FXN; (-) strand; PAM type: YTN; PAM sequence: TTT
gtatcacaactatcctatag

SEQ ID NO: 25133 - DNA, 20 bp, Artificial Sequence
  Description of Artificial Sequence: Synthetic oligonucleotide
  Target: FXN; (-) strand; PAM type: YTN; PAM sequence: CTA
aaatatttgtatcacaacta

SEQ ID NO: 25134 - DNA, 20 bp, Artificial Sequence
  Description of Artificial Sequence: Synthetic oligonucleotide
  Target: FXN; (-) strand; PAM type: YTN; PAM sequence: CTA
tactaaaatatttgtatcac

SEQ ID NO: 25135 - DNA, 20 bp, Artificial Sequence
  Description of Artificial Sequence: Synthetic oligonucleotide
  Target: FXN; (-) strand; PAM type: YTN; PAM sequence: TTC
accaaaagacatgtactata

SEQ ID NO: 25136 - DNA, 20 bp, Artificial Sequence
  Description of Artificial Sequence: Synthetic oligonucleotide
  Target: FXN; (-) strand; PAM type: YTN; PAM sequence: TTA
aggggtatacacaacagaaa

SEQ ID NO: 25137 - DNA, 20 bp, Artificial Sequence
  Description of Artificial Sequence: Synthetic oligonucleotide
  Target: FXN; (-) strand; PAM type: YTN; PAM sequence: CTT
aaggggtatacacaacagaa

SEQ ID NO: 25138 - DNA, 20 bp, Artificial Sequence
  Description of Artificial Sequence: Synthetic oligonucleotide
  Target: FXN; (-) strand; PAM type: YTN; PAM sequence: CTC
ttaaggggtatacacaacag

SEQ ID NO: 25139 - DNA, 20 bp, Artificial Sequence
  Description of Artificial Sequence: Synthetic oligonucleotide
  Target: FXN; (-) strand; PAM type: YTN; PAM sequence: CTC
cactcttaaggggtatacac

SEQ ID NO: 25140 - DNA, 20 bp, Artificial Sequence
  Description of Artificial Sequence: Synthetic oligonucleotide
  Target: FXN; (-) strand; PAM type: YTN; PAM sequence: TTA
gccaggatcatcagctccac

SEQ ID NO: 25141 - DNA, 20 bp, Artificial Sequence
  Description of Artificial Sequence: Synthetic oligonucleotide
  Target: FXN; (-) strand; PAM type: YTN; PAM sequence: TTG
ttagccaggatcatcagctc

SEQ ID NO: 25142 - DNA, 20 bp, Artificial Sequence
  Description of Artificial Sequence: Synthetic oligonucleotide
  Target: FXN; (-) strand; PAM type: YTN; PAM sequence: CTT
gttagccaggatcatcagct

SEQ ID NO: 25143 - DNA, 20 bp, Artificial Sequence
  Description of Artificial Sequence: Synthetic oligonucleotide
  Target: FXN; (-) strand; PAM type: YTN; PAM sequence: TTC
accttgttagccaggatcat

SEQ ID NO: 25144 - DNA, 20 bp, Artificial Sequence
  Description of Artificial Sequence: Synthetic oligonucleotide
  Target: FXN; (-) strand; PAM type: YTN; PAM sequence: TTT
caccttgttagccaggatca

SEQ ID NO: 25145 - DNA, 20 bp, Artificial Sequence
  Description of Artificial Sequence: Synthetic oligonucleotide
  Target: FXN; (-) strand; PAM type: YTN; PAM sequence: TTA
gtagagacggggtttcacct

SEQ ID NO: 25146 - DNA, 20 bp, Artificial Sequence
  Description of Artificial Sequence: Synthetic oligonucleotide
  Target: FXN; (-) strand; PAM type: YTN; PAM sequence: TTT
agtagagacggggtttcacc

SEQ ID NO: 25147 - DNA, 20 bp, Artificial Sequence
  Description of Artificial Sequence: Synthetic oligonucleotide
  Target: FXN; (-) strand; PAM type: YTN; PAM sequence: TTT
tagtagagacggggtttcac

SEQ ID NO: 25148 - DNA, 20 bp, Artificial Sequence
  Description of Artificial Sequence: Synthetic oligonucleotide
  Target: FXN; (-) strand; PAM type: YTN; PAM sequence: TTT
ttagtagagacggggtttca

SEQ ID NO: 25149 - DNA, 20 bp, Artificial Sequence
  Description of Artificial Sequence: Synthetic oligonucleotide
  Target: FXN; (-) strand; PAM type: YTN; PAM sequence: TTG
tatttttagtagagacgggg

SEQ ID NO: 25150 - DNA, 20 bp, Artificial Sequence
  Description of Artificial Sequence: Synthetic oligonucleotide
  Target: FXN; (-) strand; PAM type: YTN; PAM sequence: TTT
gtatttttagtagagacggg

SEQ ID NO: 25151 - DNA, 20 bp, Artificial Sequence
  Description of Artificial Sequence: Synthetic oligonucleotide
  Target: FXN; (-) strand; PAM type: YTN; PAM sequence: TTT
tgtatttttagtagagacgg

SEQ ID NO: 25152 - DNA, 20 bp, Artificial Sequence
  Description of Artificial Sequence: Synthetic oligonucleotide
  Target: FXN; (-) strand; PAM type: YTN; PAM sequence: TTT
ttgtatttttagtagagacg

SEQ ID NO: 25153 - DNA, 20 bp, Artificial Sequence
  Description of Artificial Sequence: Synthetic oligonucleotide
  Target: FXN; (-) strand; PAM type: YTN; PAM sequence: TTT
tttgtatttttagtagagac

SEQ ID NO: 25154 - DNA, 20 bp, Artificial Sequence
  Description of Artificial Sequence: Synthetic oligonucleotide
  Target: FXN; (-) strand; PAM type: YTN; PAM sequence: CTA
attttttgtatttttagtag

SEQ ID NO: 25155 - DNA, 20 bp, Artificial Sequence
  Description of Artificial Sequence: Synthetic oligonucleotide
  Target: FXN; (-) strand; PAM type: YTN; PAM sequence: CTA
ccacgcccggctaatttttt

SEQ ID NO: 25156 - DNA, 20 bp, Artificial Sequence
  Description of Artificial Sequence: Synthetic oligonucleotide
  Target: FXN; (-) strand; PAM type: YTN; PAM sequence: CTA
caggcgcccgctaccacgcc

SEQ ID NO: 25157 - DNA, 20 bp, Artificial Sequence
  Description of Artificial Sequence: Synthetic oligonucleotide
  Target: FXN; (-) strand; PAM type: YTN; PAM sequence: CTG
ggactacaggcgcccgctac

SEQ ID NO: 25158 - DNA, 20 bp, Artificial Sequence
  Description of Artificial Sequence: Synthetic oligonucleotide
  Target: FXN; (-) strand; PAM type: YTN; PAM sequence: CTC
ccgagtagctgggactacag

SEQ ID NO: 25159 - DNA, 20 bp, Artificial Sequence
  Description of Artificial Sequence: Synthetic oligonucleotide
  Target: FXN; (-) strand; PAM type: YTN; PAM sequence: CTC
agcctcccgagtagctggga

SEQ ID NO: 25160 - DNA, 20 bp, Artificial Sequence
  Description of Artificial Sequence: Synthetic oligonucleotide
  Target: FXN; (-) strand; PAM type: YTN; PAM sequence: CTG
cctcagcctcccgagtagct

SEQ ID NO: 25161 - DNA, 20 bp, Artificial Sequence
  Description of Artificial Sequence: Synthetic oligonucleotide
  Target: FXN; (-) strand; PAM type: YTN; PAM sequence: CTC
ctgcctcagcctcccgagta

SEQ ID NO: 25162 - DNA, 20 bp, Artificial Sequence
  Description of Artificial Sequence: Synthetic oligonucleotide
  Target: FXN; (-) strand; PAM type: YTN; PAM sequence: TTC
tcctgcctcagcctcccgag

SEQ ID NO: 25163 - DNA, 20 bp, Artificial Sequence
  Description of Artificial Sequence: Synthetic oligonucleotide
  Target: FXN; (-) strand; PAM type: YTN; PAM sequence: TTC
acgccattctcctgcctcag

SEQ ID NO: 25164 - DNA, 20 bp, Artificial Sequence
  Description of Artificial Sequence: Synthetic oligonucleotide
  Target: FXN; (-) strand; PAM type: YTN; PAM sequence: CTC
ccgggttcacgccattctcc

SEQ ID NO: 25165 - DNA, 20 bp, Artificial Sequence
  Description of Artificial Sequence: Synthetic oligonucleotide
  Target: FXN; (-) strand; PAM type: YTN; PAM sequence: CTC
cgcctcccgggttcacgcca

SEQ ID NO: 25166 - DNA, 20 bp, Artificial Sequence
  Description of Artificial Sequence: Synthetic oligonucleotide
  Target: FXN; (-) strand; PAM type: YTN; PAM sequence: CTG
caagcaagctccgcctcccg

SEQ ID NO: 25167 - DNA, 20 bp, Artificial Sequence
  Description of Artificial Sequence: Synthetic oligonucleotide
  Target: FXN; (-) strand; PAM type: YTN; PAM sequence: CTC
actgcaagcaagctccgcct

SEQ ID NO: 25168 - DNA, 20 bp, Artificial Sequence
  Description of Artificial Sequence: Synthetic oligonucleotide
  Target: FXN; (-) strand; PAM type: YTN; PAM sequence: CTC
ggctcactgcaagcaagctc

SEQ ID NO: 25169 - DNA, 20 bp, Artificial Sequence
  Description of Artificial Sequence: Synthetic oligonucleotide
  Target: FXN; (-) strand; PAM type: YTN; PAM sequence: CTG
gagtgcagtggcgcgatctc

SEQ ID NO: 25170 - DNA, 20 bp, Artificial Sequence
  Description of Artificial Sequence: Synthetic oligonucleotide
  Target: FXN; (-) strand; PAM type: YTN; PAM sequence: CTG
tcgcccaggctggagtgcag

SEQ ID NO: 25171 - DNA, 20 bp, Artificial Sequence
  Description of Artificial Sequence: Synthetic oligonucleotide
  Target: FXN; (-) strand; PAM type: YTN; PAM sequence: CTC
tgtcgcccaggctggagtgc

SEQ ID NO: 25172 - DNA, 20 bp, Artificial Sequence
  Description of Artificial Sequence: Synthetic oligonucleotide
  Target: FXN; (-) strand; PAM type: YTN; PAM sequence: CTC
gctctgtcgcccaggctgga

SEQ ID NO: 25173 - DNA, 20 bp, Artificial Sequence
  Description of Artificial Sequence: Synthetic oligonucleotide
  Target: FXN; (-) strand; PAM type: YTN; PAM sequence: TTG
agacggagtctcgctctgtc

SEQ ID NO: 25174 - DNA, 20 bp, Artificial Sequence
  Description of Artificial Sequence: Synthetic oligonucleotide
  Target: FXN; (-) strand; PAM type: YTN; PAM sequence: TTT
gagacggagtctcgctctgt

SEQ ID NO: 25175 - DNA, 20 bp, Artificial Sequence
  Description of Artificial Sequence: Synthetic oligonucleotide
  Target: FXN; (-) strand; PAM type: YTN; PAM sequence: TTT
tgagacggagtctcgctctg

SEQ ID NO: 25176 - DNA, 20 bp, Artificial Sequence
  Description of Artificial Sequence: Synthetic oligonucleotide
  Target: FXN; (-) strand; PAM type: YTN; PAM sequence: TTT
ttgagacggagtctcgctct

SEQ ID NO: 25177 - DNA, 20 bp, Artificial Sequence
  Description of Artificial Sequence: Synthetic oligonucleotide
  Target: FXN; (-) strand; PAM type: YTN; PAM sequence: TTT
tttgagacggagtctcgctc

SEQ ID NO: 25178 - DNA, 20 bp, Artificial Sequence
  Description of Artificial Sequence: Synthetic oligonucleotide
  Target: FXN; (-) strand; PAM type: YTN; PAM sequence: TTT
ttttgagacggagtctcgct

SEQ ID NO: 25179 - DNA, 20 bp, Artificial Sequence
  Description of Artificial Sequence: Synthetic oligonucleotide
  Target: FXN; (-) strand; PAM type: YTN; PAM sequence: TTT
tttttgagacggagtctcgc

SEQ ID NO: 25180 - DNA, 20 bp, Artificial Sequence
  Description of Artificial Sequence: Synthetic oligonucleotide
  Target: FXN; (-) strand; PAM type: YTN; PAM sequence: TTT
ttttttgagacggagtctcg

SEQ ID NO: 25181 - DNA, 20 bp, Artificial Sequence
  Description of Artificial Sequence: Synthetic oligonucleotide
  Target: FXN; (-) strand; PAM type: YTN; PAM sequence: TTT
tttttttgagacggagtctc

SEQ ID NO: 25182 - DNA, 20 bp, Artificial Sequence
  Description of Artificial Sequence: Synthetic oligonucleotide
  Target: FXN; (-) strand; PAM type: YTN; PAM sequence: TTT
ttttttttgagacggagtct

SEQ ID NO: 25183 - DNA, 20 bp, Artificial Sequence
  Description of Artificial Sequence: Synthetic oligonucleotide
  Target: FXN; (-) strand; PAM type: YTN; PAM sequence: TTT
tttttttttgagacggagtc

SEQ ID NO: 25184 - DNA, 20 bp, Artificial Sequence
  Description of Artificial Sequence: Synthetic oligonucleotide
  Target: FXN; (-) strand; PAM type: YTN; PAM sequence: TTT
ttttttttttgagacggagt

SEQ ID NO: 25185 - DNA, 20 bp, Artificial Sequence
  Description of Artificial Sequence: Synthetic oligonucleotide
  Target: FXN; (-) strand; PAM type: YTN; PAM sequence: TTT
tttttttttttgagacggag

SEQ ID NO: 25186 - DNA, 20 bp, Artificial Sequence
  Description of Artificial Sequence: Synthetic oligonucleotide
  Target: FXN; (-) strand; PAM type: YTN; PAM sequence: TTT
ttttttttttttgagacgga

SEQ ID NO: 25187 - DNA, 20 bp, Artificial Sequence
  Description of Artificial Sequence: Synthetic oligonucleotide
  Target: FXN; (-) strand; PAM type: YTN; PAM sequence: TTT
tttttttttttttgagacgg

SEQ ID NO: 25188 - DNA, 20 bp, Artificial Sequence
  Description of Artificial Sequence: Synthetic oligonucleotide
  Target: FXN; (-) strand; PAM type: YTN; PAM sequence: TTT
ttttttttttttttgagacg

SEQ ID NO: 25189 - DNA, 20 bp, Artificial Sequence
  Description of Artificial Sequence: Synthetic oligonucleotide
  Target: FXN; (-) strand; PAM type: YTN; PAM sequence: TTT
tttttttttttttttgagac

SEQ ID NO: 25190 - DNA, 20 bp, Artificial Sequence
  Description of Artificial Sequence: Synthetic oligonucleotide
  Target: FXN; (-) strand; PAM type: YTN; PAM sequence: TTT
ttttttttttttttttgaga

SEQ ID NO: 25191 - DNA, 20 bp, Artificial Sequence
  Description of Artificial Sequence: Synthetic oligonucleotide
  Target: FXN; (-) strand; PAM type: YTN; PAM sequence: CTT
tttttttttttttttttgag

SEQ ID NO: 25192 - DNA, 20 bp, Artificial Sequence
  Description of Artificial Sequence: Synthetic oligonucleotide
  Target: FXN; (-) strand; PAM type: YTN; PAM sequence: CTC
tttttttttttttttttttg

SEQ ID NO: 25193 - DNA, 20 bp, Artificial Sequence
  Description of Artificial Sequence: Synthetic oligonucleotide
  Target: FXN; (-) strand; PAM type: YTN; PAM sequence: CTC
cactcttttttttttttttt

SEQ ID NO: 25194 - DNA, 20 bp, Artificial Sequence
  Description of Artificial Sequence: Synthetic oligonucleotide
  Target: FXN; (-) strand; PAM type: YTN; PAM sequence: CTA
tgacccatcagctccactct

SEQ ID NO: 25195 - DNA, 20 bp, Artificial Sequence
  Description of Artificial Sequence: Synthetic oligonucleotide
  Target: FXN; (-) strand; PAM type: YTN; PAM sequence: TTA
catgctatgacccatcagct

SEQ ID NO: 25196 - DNA, 20 bp, Artificial Sequence
  Description of Artificial Sequence: Synthetic oligonucleotide
  Target: FXN; (-) strand; PAM type: YTN; PAM sequence: TTT
acatgctatgacccatcagc

SEQ ID NO: 25197 - DNA, 20 bp, Artificial Sequence
  Description of Artificial Sequence: Synthetic oligonucleotide
  Target: FXN; (-) strand; PAM type: YTN; PAM sequence: TTG
aatgcatttacatgctatga

SEQ ID NO: 25198 - DNA, 20 bp, Artificial Sequence
  Description of Artificial Sequence: Synthetic oligonucleotide
  Target: FXN; (-) strand; PAM type: YTN; PAM sequence: CTA
aagttgaatgcatttacatg

SEQ ID NO: 25199 - DNA, 20 bp, Artificial Sequence
  Description of Artificial Sequence: Synthetic oligonucleotide
  Target: FXN; (-) strand; PAM type: YTN; PAM sequence: CTA
ctaaagttgaatgcatttac

SEQ ID NO: 25200 - DNA, 20 bp, Artificial Sequence
  Description of Artificial Sequence: Synthetic oligonucleotide
  Target: FXN; (-) strand; PAM type: YTN; PAM sequence: TTG
gacagtatctactaaagttg

SEQ ID NO: 25201 - DNA, 20 bp, Artificial Sequence
  Description of Artificial Sequence: Synthetic oligonucleotide
  Target: FXN; (-) strand; PAM type: YTN; PAM sequence: CTG
ttggacagtatctactaaag

SEQ ID NO: 25202 - DNA, 20 bp, Artificial Sequence
  Description of Artificial Sequence: Synthetic oligonucleotide
  Target: FXN; (-) strand; PAM type: YTN; PAM sequence: TTG
gaaaactgttggacagtatc

SEQ ID NO: 25203 - DNA, 20 bp, Artificial Sequence
  Description of Artificial Sequence: Synthetic oligonucleotide
  Target: FXN; (-) strand; PAM type: YTN; PAM sequence: TTT
ggaaaactgttggacagtat

SEQ ID NO: 25204 - DNA, 20 bp, Artificial Sequence
  Description of Artificial Sequence: Synthetic oligonucleotide
  Target: FXN; (-) strand; PAM type: YTN; PAM sequence: CTT
tggaaaactgttggacagta

SEQ ID NO: 25205 - DNA, 20 bp, Artificial Sequence
  Description of Artificial Sequence: Synthetic oligonucleotide
  Target: FXN; (-) strand; PAM type: YTN; PAM sequence: TTG
gacaatcactttggaaaact

SEQ ID NO: 25206 - DNA, 20 bp, Artificial Sequence
  Description of Artificial Sequence: Synthetic oligonucleotide
  Target: FXN; (-) strand; PAM type: YTN; PAM sequence: CTG
ataggcaagtaagttggaca

SEQ ID NO: 25207 - DNA, 20 bp, Artificial Sequence
  Description of Artificial Sequence: Synthetic oligonucleotide
  Target: FXN; (-) strand; PAM type: YTN; PAM sequence: CTG
ctgataggcaagtaagttgg

SEQ ID NO: 25208 - DNA, 20 bp, Artificial Sequence
  Description of Artificial Sequence: Synthetic oligonucleotide
  Target: FXN; (-) strand; PAM type: YTN; PAM sequence: TTC
agatactgctgataggcaag

SEQ ID NO: 25209 - DNA, 20 bp, Artificial Sequence
  Description of Artificial Sequence: Synthetic oligonucleotide
  Target: FXN; (-) strand; PAM type: YTN; PAM sequence: TTT
cagatactgctgataggcaa

SEQ ID NO: 25210 - DNA, 20 bp, Artificial Sequence
  Description of Artificial Sequence: Synthetic oligonucleotide
  Target: FXN; (-) strand; PAM type: YTN; PAM sequence: TTT
tcagatactgctgataggca

SEQ ID NO: 25211 - DNA, 20 bp, Artificial Sequence
  Description of Artificial Sequence: Synthetic oligonucleotide
  Target: FXN; (-) strand; PAM type: YTN; PAM sequence: CTT
ttcagatactgctgataggc

SEQ ID NO: 25212 - DNA, 20 bp, Artificial Sequence
  Description of Artificial Sequence: Synthetic oligonucleotide
  Target: FXN; (-) strand; PAM type: YTN; PAM sequence: CTA
gacttttcagatactgctga

SEQ ID NO: 25213 - DNA, 20 bp, Artificial Sequence
  Description of Artificial Sequence: Synthetic oligonucleotide
  Target: FXN; (-) strand; PAM type: YTN; PAM sequence: TTG
gccaagaaaagaagcaacta

SEQ ID NO: 25214 - DNA, 20 bp, Artificial Sequence
  Description of Artificial Sequence: Synthetic oligonucleotide
  Target: FXN; (-) strand; PAM type: YTN; PAM sequence: CTC
aaaaaaaaaaaaagagttgg

SEQ ID NO: 25215 - DNA, 20 bp, Artificial Sequence
  Description of Artificial Sequence: Synthetic oligonucleotide
  Target: FXN; (-) strand; PAM type: YTN; PAM sequence: CTC
catctcaaaaaaaaaaaaag

SEQ ID NO: 25216 - DNA, 20 bp, Artificial Sequence
  Description of Artificial Sequence: Synthetic oligonucleotide
  Target: FXN; (-) strand; PAM type: YTN; PAM sequence: CTG
ggcaacaagagcaaaactcc

SEQ ID NO: 25217 - DNA, 20 bp, Artificial Sequence
  Description of Artificial Sequence: Synthetic oligonucleotide
  Target: FXN; (-) strand; PAM type: YTN; PAM sequence: CTC
cagcctgggcaacaagagca

SEQ ID NO: 25218 - DNA, 20 bp, Artificial Sequence
  Description of Artificial Sequence: Synthetic oligonucleotide
  Target: FXN; (-) strand; PAM type: YTN; PAM sequence: TTG
cgctccagcctgggcaacaa

SEQ ID NO: 25219 - DNA, 20 bp, Artificial Sequence
  Description of Artificial Sequence: Synthetic oligonucleotide
  Target: FXN; (-) strand; PAM type: YTN; PAM sequence: TTG
cagtgagcagaggacgtgcc

SEQ ID NO: 25220 - DNA, 20 bp, Artificial Sequence
  Description of Artificial Sequence: Synthetic oligonucleotide
  Target: FXN; (-) strand; PAM type: YTN; PAM sequence: TTG
aacccaggaggcggaggttg

SEQ ID NO: 25221 - DNA, 20 bp, Artificial Sequence
  Description of Artificial Sequence: Synthetic oligonucleotide
  Target: FXN; (-) strand; PAM type: YTN; PAM sequence: CTT
gaacccaggaggcggaggtt

SEQ ID NO: 25222 - DNA, 20 bp, Artificial Sequence
  Description of Artificial Sequence: Synthetic oligonucleotide
  Target: FXN; (-) strand; PAM type: YTN; PAM sequence: TTG
cttgaacccaggaggcggag

SEQ ID NO: 25223 - DNA, 20 bp, Artificial Sequence
  Description of Artificial Sequence: Synthetic oligonucleotide
  Target: FXN; (-) strand; PAM type: YTN; PAM sequence: CTG
aggcaggagaattgcttgaa

SEQ ID NO: 25224 - DNA, 20 bp, Artificial Sequence
  Description of Artificial Sequence: Synthetic oligonucleotide
  Target: FXN; (-) strand; PAM type: YTN; PAM sequence: CTC
gggaggctgaggcaggagaa

SEQ ID NO: 25225 - DNA, 20 bp, Artificial Sequence
  Description of Artificial Sequence: Synthetic oligonucleotide
  Target: FXN; (-) strand; PAM type: YTN; PAM sequence: CTA
ctcgggaggctgaggcagga

SEQ ID NO: 25226 - DNA, 20 bp, Artificial Sequence
  Description of Artificial Sequence: Synthetic oligonucleotide
  Target: FXN; (-) strand; PAM type: YTN; PAM sequence: CTG
taatcccagctactcgggag

SEQ ID NO: 25227 - DNA, 20 bp, Artificial Sequence
  Description of Artificial Sequence: Synthetic oligonucleotide
  Target: FXN; (-) strand; PAM type: YTN; PAM sequence: TTA
gccgggcatagtggcgcatg

SEQ ID NO: 25228 - DNA, 20 bp, Artificial Sequence
  Description of Artificial Sequence: Synthetic oligonucleotide
  Target: FXN; (-) strand; PAM type: YTN; PAM sequence: CTA
aaaatacaaaattagccggg

SEQ ID NO: 25229 - DNA, 20 bp, Artificial Sequence
  Description of Artificial Sequence: Synthetic oligonucleotide
  Target: FXN; (-) strand; PAM type: YTN; PAM sequence: CTA
ctaaaaatacaaaattagcc

SEQ ID NO: 25230 - DNA, 20 bp, Artificial Sequence
  Description of Artificial Sequence: Synthetic oligonucleotide
  Target: FXN; (-) strand; PAM type: YTN; PAM sequence: CTC
tactaaaaatacaaaattag

SEQ ID NO: 25231 - DNA, 20 bp, Artificial Sequence
  Description of Artificial Sequence: Synthetic oligonucleotide
  Target: FXN; (-) strand; PAM type: YTN; PAM sequence: CTG
tctctactaaaaatacaaaa

SEQ ID NO: 25232 - DNA, 20 bp, Artificial Sequence
  Description of Artificial Sequence: Synthetic oligonucleotide
  Target: FXN; (-) strand; PAM type: YTN; PAM sequence: TTG
accaacatggagaaaccctg

SEQ ID NO: 25233 - DNA, 20 bp, Artificial Sequence
  Description of Artificial Sequence: Synthetic oligonucleotide
  Target: FXN; (-) strand; PAM type: YTN; PAM sequence: CTT
gaccaacatggagaaaccct

SEQ ID NO: 25234 - DNA, 20 bp, Artificial Sequence
  Description of Artificial Sequence: Synthetic oligonucleotide
  Target: FXN; (-) strand; PAM type: YTN; PAM sequence: TTC
gagaccagcttgaccaacat

SEQ ID NO: 25235 - DNA, 20 bp, Artificial Sequence
  Description of Artificial Sequence: Synthetic oligonucleotide
  Target: FXN; (-) strand; PAM type: YTN; PAM sequence: TTA
ggagttcgagaccagcttga

SEQ ID NO: 25236 - DNA, 20 bp, Artificial Sequence
  Description of Artificial Sequence: Synthetic oligonucleotide
  Target: FXN; (-) strand; PAM type: YTN; PAM sequence: CTG
aggttaggagttcgagacca

SEQ ID NO: 25237 - DNA, 20 bp, Artificial Sequence
  Description of Artificial Sequence: Synthetic oligonucleotide
  Target: FXN; (-) strand; PAM type: YTN; PAM sequence: TTC
gggaggccgaggcgggcgga

SEQ ID NO: 25238 - DNA, 20 bp, Artificial Sequence
  Description of Artificial Sequence: Synthetic oligonucleotide
  Target: FXN; (-) strand; PAM type: YTN; PAM sequence: CTT
cgggaggccgaggcgggcgg

SEQ ID NO: 25239 - DNA, 20 bp, Artificial Sequence
  Description of Artificial Sequence: Synthetic oligonucleotide
  Target: FXN; (-) strand; PAM type: YTN; PAM sequence: CTG
taatcccagcacttcgggag

SEQ ID NO: 25240 - DNA, 20 bp, Artificial Sequence
  Description of Artificial Sequence: Synthetic oligonucleotide
  Target: FXN; (-) strand; PAM type: YTN; PAM sequence: CTC
atgcctgtaatcccagcact

SEQ ID NO: 25241 - DNA, 20 bp, Artificial Sequence
  Description of Artificial Sequence: Synthetic oligonucleotide
  Target: FXN; (-) strand; PAM type: YTN; PAM sequence: CTG
gcgcggtggctcatgcctgt

SEQ ID NO: 25242 - DNA, 20 bp, Artificial Sequence
  Description of Artificial Sequence: Synthetic oligonucleotide
  Target: FXN; (-) strand; PAM type: YTN; PAM sequence: TTG
gccggcctggcgcggtggct

SEQ ID NO: 25243 - DNA, 20 bp, Artificial Sequence
  Description of Artificial Sequence: Synthetic oligonucleotide
  Target: FXN; (-) strand; PAM type: YTN; PAM sequence: TTA
aagtaaaataaaataaaata

SEQ ID NO: 25244 - DNA, 20 bp, Artificial Sequence
  Description of Artificial Sequence: Synthetic oligonucleotide
  Target: FXN; (-) strand; PAM type: YTN; PAM sequence: TTT
aaagtaaaataaaataaaat

SEQ ID NO: 25245 - DNA, 20 bp, Artificial Sequence
  Description of Artificial Sequence: Synthetic oligonucleotide
  Target: FXN; (-) strand; PAM type: YTN; PAM sequence: CTT
taaagtaaaataaaataaaa

SEQ ID NO: 25246 - DNA, 20 bp, Artificial Sequence
  Description of Artificial Sequence: Synthetic oligonucleotide
  Target: FXN; (-) strand; PAM type: YTN; PAM sequence: CTG
tctttaaagtaaaataaaat

SEQ ID NO: 25247 - DNA, 20 bp, Artificial Sequence
  Description of Artificial Sequence: Synthetic oligonucleotide
  Target: FXN; (-) strand; PAM type: YTN; PAM sequence: CTG
ggtgacaaagtgaaaccctg

SEQ ID NO: 25248 - DNA, 20 bp, Artificial Sequence
  Description of Artificial Sequence: Synthetic oligonucleotide
  Target: FXN; (-) strand; PAM type: YTN; PAM sequence: TTC
catcctgggtgacaaagtga

SEQ ID NO: 25249 - DNA, 20 bp, Artificial Sequence
  Description of Artificial Sequence: Synthetic oligonucleotide
  Target: FXN; (-) strand; PAM type: YTN; PAM sequence: TTG
cattccatcctgggtgacaa

SEQ ID NO: 25250 - DNA, 20 bp, Artificial Sequence
  Description of Artificial Sequence: Synthetic oligonucleotide
  Target: FXN; (-) strand; PAM type: YTN; PAM sequence: CTG
tgatcgtgccattgcattcc

SEQ ID NO: 25251 - DNA, 20 bp, Artificial Sequence
  Description of Artificial Sequence: Synthetic oligonucleotide
  Target: FXN; (-) strand; PAM type: YTN; PAM sequence: CTG
cagtgagctgtgatcgtgcc

SEQ ID NO: 25252 - DNA, 20 bp, Artificial Sequence
  Description of Artificial Sequence: Synthetic oligonucleotide
  Target: FXN; (-) strand; PAM type: YTN; PAM sequence: CTG
aggtgggagggatcacccga

SEQ ID NO: 25253 - DNA, 20 bp, Artificial Sequence
  Description of Artificial Sequence: Synthetic oligonucleotide
  Target: FXN; (-) strand; PAM type: YTN; PAM sequence: CTC
aggagcctgaggtgggaggg

SEQ ID NO: 25254 - DNA, 20 bp, Artificial Sequence
  Description of Artificial Sequence: Synthetic oligonucleotide
  Target: FXN; (-) strand; PAM type: YTN; PAM sequence: CTC
ctcaggagcctgaggtggga

SEQ ID NO: 25255 - DNA, 20 bp, Artificial Sequence
  Description of Artificial Sequence: Synthetic oligonucleotide
  Target: FXN; (-) strand; PAM type: YTN; PAM sequence: CTA
gctcctcaggagcctgaggt

SEQ ID NO: 25256 - DNA, 20 bp, Artificial Sequence
  Description of Artificial Sequence: Synthetic oligonucleotide
  Target: FXN; (-) strand; PAM type: YTN; PAM sequence: TTC
tagctcctcaggagcctgag

SEQ ID NO: 25257 - DNA, 20 bp, Artificial Sequence
  Description of Artificial Sequence: Synthetic oligonucleotide
  Target: FXN; (-) strand; PAM type: YTN; PAM sequence: CTG
tagttctagctcctcaggag

SEQ ID NO: 25258 - DNA, 20 bp, Artificial Sequence
  Description of Artificial Sequence: Synthetic oligonucleotide
  Target: FXN; (-) strand; PAM type: YTN; PAM sequence: CTG
ggcatggcccatgcctgtag

SEQ ID NO: 25259 - DNA, 20 bp, Artificial Sequence
  Description of Artificial Sequence: Synthetic oligonucleotide
  Target: FXN; (-) strand; PAM type: YTN; PAM sequence: TTA
gctgggcatggcccatgcct

SEQ ID NO: 25260 - DNA, 20 bp, Artificial Sequence
  Description of Artificial Sequence: Synthetic oligonucleotide
  Target: FXN; (-) strand; PAM type: YTN; PAM sequence: TTA
aaaaattagctgggcatggc

SEQ ID NO: 25261 - DNA, 20 bp, Artificial Sequence
  Description of Artificial Sequence: Synthetic oligonucleotide
  Target: FXN; (-) strand; PAM type: YTN; PAM sequence: CTA
ccaaaaattaaaaaattagc

SEQ ID NO: 25262 - DNA, 20 bp, Artificial Sequence
  Description of Artificial Sequence: Synthetic oligonucleotide
  Target: FXN; (-) strand; PAM type: YTN; PAM sequence: CTC
taccaaaaattaaaaaatta

SEQ ID NO: 25263 - DNA, 20 bp, Artificial Sequence
  Description of Artificial Sequence: Synthetic oligonucleotide
  Target: FXN; (-) strand; PAM type: YTN; PAM sequence: CTG
agacaacagagaccccgtct

SEQ ID NO: 25264 - DNA, 20 bp, Artificial Sequence
  Description of Artificial Sequence: Synthetic oligonucleotide
  Target: FXN; (-) strand; PAM type: YTN; PAM sequence: TTG
aacccaggaatctgagacaa

SEQ ID NO: 25265 - DNA, 20 bp, Artificial Sequence
  Description of Artificial Sequence: Synthetic oligonucleotide
  Target: FXN; (-) strand; PAM type: YTN; PAM sequence: CTT
gaacccaggaatctgagaca

SEQ ID NO: 25266 - DNA, 20 bp, Artificial Sequence
  Description of Artificial Sequence: Synthetic oligonucleotide
  Target: FXN; (-) strand; PAM type: YTN; PAM sequence: TTG
ggaggccaagggagaaggat

SEQ ID NO: 25267 - DNA, 20 bp, Artificial Sequence
  Description of Artificial Sequence: Synthetic oligonucleotide
  Target: FXN; (-) strand; PAM type: YTN; PAM sequence: TTT
gggaggccaagggagaagga

SEQ ID NO: 25268 - DNA, 20 bp, Artificial Sequence
  Description of Artificial Sequence: Synthetic oligonucleotide
  Target: FXN; (-) strand; PAM type: YTN; PAM sequence: CTT
tgggaggccaagggagaagg

SEQ ID NO: 25269 - DNA, 20 bp, Artificial Sequence
  Description of Artificial Sequence: Synthetic oligonucleotide
  Target: FXN; (-) strand; PAM type: YTN; PAM sequence: CTG
taataccagaactttgggag

SEQ ID NO: 25270 - DNA, 20 bp, Artificial Sequence
  Description of Artificial Sequence: Synthetic oligonucleotide
  Target: FXN; (-) strand; PAM type: YTN; PAM sequence: CTC
atgcctgtaataccagaact

SEQ ID NO: 25271 - DNA, 20 bp, Artificial Sequence
  Description of Artificial Sequence: Synthetic oligonucleotide
  Target: FXN; (-) strand; PAM type: YTN; PAM sequence: CTG
ggtgcagtggctcatgcctg

SEQ ID NO: 25272 - DNA, 20 bp, Artificial Sequence
  Description of Artificial Sequence: Synthetic oligonucleotide
  Target: FXN; (-) strand; PAM type: YTN; PAM sequence: CTG
gccatgggctgggtgcagtg

SEQ ID NO: 25273 - DNA, 20 bp, Artificial Sequence
  Description of Artificial Sequence: Synthetic oligonucleotide
  Target: FXN; (-) strand; PAM type: YTN; PAM sequence: TTA
aaaaaaaaaaaagaaaagaa

SEQ ID NO: 25274 - DNA, 20 bp, Artificial Sequence
  Description of Artificial Sequence: Synthetic oligonucleotide
  Target: FXN; (-) strand; PAM type: YTN; PAM sequence: CTC
aaattaaaaaaaaaaaaaga

SEQ ID NO: 25275 - DNA, 20 bp, Artificial Sequence
  Description of Artificial Sequence: Synthetic oligonucleotide
  Target: FXN; (-) strand; PAM type: YTN; PAM sequence: TTC
tcaaattaaaaaaaaaaaaa

SEQ ID NO: 25276 - DNA, 20 bp, Artificial Sequence
  Description of Artificial Sequence: Synthetic oligonucleotide
  Target: FXN; (-) strand; PAM type: YTN; PAM sequence: CTT
ctcaaattaaaaaaaaaaaa

SEQ ID NO: 25277 - DNA, 20 bp, Artificial Sequence
  Description of Artificial Sequence: Synthetic oligonucleotide
  Target: FXN; (-) strand; PAM type: YTN; PAM sequence: TTA
acacttctcaaattaaaaaa

SEQ ID NO: 25278 - DNA, 20 bp, Artificial Sequence
  Description of Artificial Sequence: Synthetic oligonucleotide
  Target: FXN; (-) strand; PAM type: YTN; PAM sequence: TTT
aacacttctcaaattaaaaa

SEQ ID NO: 25279 - DNA, 20 bp, Artificial Sequence
  Description of Artificial Sequence: Synthetic oligonucleotide
  Target: FXN; (-) strand; PAM type: YTN; PAM sequence: TTA
tttaacacttctcaaattaa

SEQ ID NO: 25280 - DNA, 20 bp, Artificial Sequence
  Description of Artificial Sequence: Synthetic oligonucleotide
  Target: FXN; (-) strand; PAM type: YTN; PAM sequence: TTA
tgtataatatcaaagaaaga

SEQ ID NO: 25281 - DNA, 20 bp, Artificial Sequence
  Description of Artificial Sequence: Synthetic oligonucleotide
  Target: FXN; (-) strand; PAM type: YTN; PAM sequence: TTT
atgtataatatcaaagaaag

SEQ ID NO: 25282 - DNA, 20 bp, Artificial Sequence
  Description of Artificial Sequence: Synthetic oligonucleotide
  Target: FXN; (-) strand; PAM type: YTN; PAM sequence: TTG
gtgtggtttatgtataatat

SEQ ID NO: 25283 - DNA, 20 bp, Artificial Sequence
  Description of Artificial Sequence: Synthetic oligonucleotide
  Target: FXN; (-) strand; PAM type: YTN; PAM sequence: TTT
ggtgtggtttatgtataata

SEQ ID NO: 25284 - DNA, 20 bp, Artificial Sequence
  Description of Artificial Sequence: Synthetic oligonucleotide
  Target: FXN; (-) strand; PAM type: YTN; PAM sequence: TTT
tggtgtggtttatgtataat

SEQ ID NO: 25285 - DNA, 20 bp, Artificial Sequence
  Description of Artificial Sequence: Synthetic oligonucleotide
  Target: FXN; (-) strand; PAM type: YTN; PAM sequence: CTG
aaagacattttggtgtggtt

SEQ ID NO: 25286 - DNA, 20 bp, Artificial Sequence
  Description of Artificial Sequence: Synthetic oligonucleotide
  Target: FXN; (-) strand; PAM type: YTN; PAM sequence: TTA
ctgaaagacattttggtgtg

SEQ ID NO: 25287 - DNA, 20 bp, Artificial Sequence
  Description of Artificial Sequence: Synthetic oligonucleotide
  Target: FXN; (-) strand; PAM type: YTN; PAM sequence: CTT
actgaaagacattttggtgt

SEQ ID NO: 25288 - DNA, 20 bp, Artificial Sequence
  Description of Artificial Sequence: Synthetic oligonucleotide
  Target: FXN; (-) strand; PAM type: YTN; PAM sequence: TTA
cttactgaaagacattttgg

SEQ ID NO: 25289 - DNA, 20 bp, Artificial Sequence
  Description of Artificial Sequence: Synthetic oligonucleotide
  Target: FXN; (-) strand; PAM type: YTN; PAM sequence: TTT
acttactgaaagacattttg

SEQ ID NO: 25290 - DNA, 20 bp, Artificial Sequence
  Description of Artificial Sequence: Synthetic oligonucleotide
  Target: FXN; (-) strand; PAM type: YTN; PAM sequence: TTT
tacttactgaaagacatttt

SEQ ID NO: 25291 - DNA, 20 bp, Artificial Sequence
  Description of Artificial Sequence: Synthetic oligonucleotide
  Target: FXN; (-) strand; PAM type: YTN; PAM sequence: TTC
attttacttactgaaagaca

SEQ ID NO: 25292 - DNA, 20 bp, Artificial Sequence
  Description of Artificial Sequence: Synthetic oligonucleotide
  Target: FXN; (-) strand; PAM type: YTN; PAM sequence: CTA
aaatggttcattttacttac

SEQ ID NO: 25293 - DNA, 20 bp, Artificial Sequence
  Description of Artificial Sequence: Synthetic oligonucleotide
  Target: FXN; (-) strand; PAM type: YTN; PAM sequence: CTG
tatctaaaatggttcatttt

SEQ ID NO: 25294 - DNA, 20 bp, Artificial Sequence
  Description of Artificial Sequence: Synthetic oligonucleotide
  Target: FXN; (-) strand; PAM type: YTN; PAM sequence: TTC
tgtatctaaaatggttcatt

SEQ ID NO: 25295 - DNA, 20 bp, Artificial Sequence
  Description of Artificial Sequence: Synthetic oligonucleotide
  Target: FXN; (-) strand; PAM type: YTN; PAM sequence: TTT
ctgtatctaaaatggttcat

SEQ ID NO: 25296 - DNA, 20 bp, Artificial Sequence
  Description of Artificial Sequence: Synthetic oligonucleotide
  Target: FXN; (-) strand; PAM type: YTN; PAM sequence: TTT
tctgtatctaaaatggttca

SEQ ID NO: 25297 - DNA, 20 bp, Artificial Sequence
  Description of Artificial Sequence: Synthetic oligonucleotide
  Target: FXN; (-) strand; PAM type: YTN; PAM sequence: TTA
gaattttctgtatctaaaat

SEQ ID NO: 25298 - DNA, 20 bp, Artificial Sequence
  Description of Artificial Sequence: Synthetic oligonucleotide
  Target: FXN; (-) strand; PAM type: YTN; PAM sequence: CTA
attagaattttctgtatcta

SEQ ID NO: 25299 - DNA, 20 bp, Artificial Sequence
  Description of Artificial Sequence: Synthetic oligonucleotide
  Target: FXN; (-) strand; PAM type: YTN; PAM sequence: CTA
tgccaatctaattagaattt

SEQ ID NO: 25300 - DNA, 20 bp, Artificial Sequence
  Description of Artificial Sequence: Synthetic oligonucleotide
  Target: FXN; (-) strand; PAM type: YTN; PAM sequence: TTA
actatgccaatctaattaga

SEQ ID NO: 25301 - DNA, 20 bp, Artificial Sequence
  Description of Artificial Sequence: Synthetic oligonucleotide
  Target: FXN; (-) strand; PAM type: YTN; PAM sequence: CTT
aactatgccaatctaattag

SEQ ID NO: 25302 - DNA, 20 bp, Artificial Sequence
  Description of Artificial Sequence: Synthetic oligonucleotide
  Target: FXN; (-) strand; PAM type: YTN; PAM sequence: TTG
gccttaactatgccaatcta

SEQ ID NO: 25303 - DNA, 20 bp, Artificial Sequence
  Description of Artificial Sequence: Synthetic oligonucleotide
  Target: FXN; (-) strand; PAM type: YTN; PAM sequence: TTT
ggccttaactatgccaatct

SEQ ID NO: 25304 - DNA, 20 bp, Artificial Sequence
  Description of Artificial Sequence: Synthetic oligonucleotide
  Target: FXN; (-) strand; PAM type: YTN; PAM sequence: TTT
tggccttaactatgccaatc

SEQ ID NO: 25305 - DNA, 20 bp, Artificial Sequence
  Description of Artificial Sequence: Synthetic oligonucleotide
  Target: FXN; (-) strand; PAM type: YTN; PAM sequence: TTT
ttggccttaactatgccaat

SEQ ID NO: 25306 - DNA, 20 bp, Artificial Sequence
  Description of Artificial Sequence: Synthetic oligonucleotide
  Target: FXN; (-) strand; PAM type: YTN; PAM sequence: TTA
tatttttggccttaactatg

SEQ ID NO: 25307 - DNA, 20 bp, Artificial Sequence
  Description of Artificial Sequence: Synthetic oligonucleotide
  Target: FXN; (-) strand; PAM type: YTN; PAM sequence: TTT
atatttttggccttaactat

SEQ ID NO: 25308 - DNA, 20 bp, Artificial Sequence
  Description of Artificial Sequence: Synthetic oligonucleotide
  Target: FXN; (-) strand; PAM type: YTN; PAM sequence: CTT
tatatttttggccttaacta

SEQ ID NO: 25309 - DNA, 20 bp, Artificial Sequence
  Description of Artificial Sequence: Synthetic oligonucleotide
  Target: FXN; (-) strand; PAM type: YTN; PAM sequence: CTG
aagataaggtagcaatgtca

SEQ ID NO: 25310 - DNA, 20 bp, Artificial Sequence
  Description of Artificial Sequence: Synthetic oligonucleotide
  Target: FXN; (-) strand; PAM type: YTN; PAM sequence: TTA
aaggcaagggctgaagataa

SEQ ID NO: 25311 - DNA, 20 bp, Artificial Sequence
  Description of Artificial Sequence: Synthetic oligonucleotide
  Target: FXN; (-) strand; PAM type: YTN; PAM sequence: CTT
aaaggcaagggctgaagata

SEQ ID NO: 25312 - DNA, 20 bp, Artificial Sequence
  Description of Artificial Sequence: Synthetic oligonucleotide
  Target: FXN; (-) strand; PAM type: YTN; PAM sequence: CTC
ttaaaggcaagggctgaaga

SEQ ID NO: 25313 - DNA, 20 bp, Artificial Sequence
  Description of Artificial Sequence: Synthetic oligonucleotide
  Target: FXN; (-) strand; PAM type: YTN; PAM sequence: TTG
cctcttaaaggcaagggctg

SEQ ID NO: 25314 - DNA, 20 bp, Artificial Sequence
  Description of Artificial Sequence: Synthetic oligonucleotide
  Target: FXN; (-) strand; PAM type: YTN; PAM sequence: TTT
gcctcttaaaggcaagggct

SEQ ID NO: 25315 - DNA, 20 bp, Artificial Sequence
  Description of Artificial Sequence: Synthetic oligonucleotide
  Target: FXN; (-) strand; PAM type: YTN; PAM sequence: TTC
atttgcctcttaaaggcaag

SEQ ID NO: 25316 - DNA, 20 bp, Artificial Sequence
  Description of Artificial Sequence: Synthetic oligonucleotide
  Target: FXN; (-) strand; PAM type: YTN; PAM sequence: TTG
tgttcatttgcctcttaaag

SEQ ID NO: 25317 - DNA, 20 bp, Artificial Sequence
  Description of Artificial Sequence: Synthetic oligonucleotide
  Target: FXN; (-) strand; PAM type: YTN; PAM sequence: TTT
gtgttcatttgcctcttaaa

SEQ ID NO: 25318 - DNA, 20 bp, Artificial Sequence
  Description of Artificial Sequence: Synthetic oligonucleotide
  Target: FXN; (-) strand; PAM type: YTN; PAM sequence: TTT
tgtgttcatttgcctcttaa

SEQ ID NO: 25319 - DNA, 20 bp, Artificial Sequence
  Description of Artificial Sequence: Synthetic oligonucleotide
  Target: FXN; (-) strand; PAM type: YTN; PAM sequence: CTG
tattttgtgttcatttgcct

SEQ ID NO: 25320 - DNA, 20 bp, Artificial Sequence
  Description of Artificial Sequence: Synthetic oligonucleotide
  Target: FXN; (-) strand; PAM type: YTN; PAM sequence: TTC
acctgtattttgtgttcatt

SEQ ID NO: 25321 - DNA, 20 bp, Artificial Sequence
  Description of Artificial Sequence: Synthetic oligonucleotide
  Target: FXN; (-) strand; PAM type: YTN; PAM sequence: CTC
agaaccaagcaagattcacc

SEQ ID NO: 25322 - DNA, 20 bp, Artificial Sequence
  Description of Artificial Sequence: Synthetic oligonucleotide
  Target: FXN; (-) strand; PAM type: YTN; PAM sequence: CTG
tctcagaaccaagcaagatt

SEQ ID NO: 25323 - DNA, 20 bp, Artificial Sequence
  Description of Artificial Sequence: Synthetic oligonucleotide
  Target: FXN; (-) strand; PAM type: YTN; PAM sequence: TTC
actgtctcagaaccaagcaa

SEQ ID NO: 25324 - DNA, 20 bp, Artificial Sequence
  Description of Artificial Sequence: Synthetic oligonucleotide
  Target: FXN; (-) strand; PAM type: YTN; PAM sequence: CTT
cactgtctcagaaccaagca

SEQ ID NO: 25325 - DNA, 20 bp, Artificial Sequence
  Description of Artificial Sequence: Synthetic oligonucleotide
  Target: FXN; (-) strand; PAM type: YTN; PAM sequence: CTG
ggggaaagtccttcactgtc

SEQ ID NO: 25326 - DNA, 20 bp, Artificial Sequence
  Description of Artificial Sequence: Synthetic oligonucleotide
  Target: FXN; (-) strand; PAM type: YTN; PAM sequence: TTA
aatactgggggaaagtcctt

SEQ ID NO: 25327 - DNA, 20 bp, Artificial Sequence
  Description of Artificial Sequence: Synthetic oligonucleotide
  Target: FXN; (-) strand; PAM type: YTN; PAM sequence: TTT
aaatactgggggaaagtcct

SEQ ID NO: 25328 - DNA, 20 bp, Artificial Sequence
  Description of Artificial Sequence: Synthetic oligonucleotide
  Target: FXN; (-) strand; PAM type: YTN; PAM sequence: TTA
tgtaaatatatttaaatact

SEQ ID NO: 25329 - DNA, 20 bp, Artificial Sequence
  Description of Artificial Sequence: Synthetic oligonucleotide
  Target: FXN; (-) strand; PAM type: YTN; PAM sequence: CTG
gttatgtaaatatatttaaa

SEQ ID NO: 25330 - DNA, 20 bp, Artificial Sequence
  Description of Artificial Sequence: Synthetic oligonucleotide
  Target: FXN; (-) strand; PAM type: YTN; PAM sequence: TTA
tgtaactggttatgtaaata

SEQ ID NO: 25331 - DNA, 20 bp, Artificial Sequence
  Description of Artificial Sequence: Synthetic oligonucleotide
  Target: FXN; (-) strand; PAM type: YTN; PAM sequence: TTT
atgtaactggttatgtaaat

SEQ ID NO: 25332 - DNA, 20 bp, Artificial Sequence
  Description of Artificial Sequence: Synthetic oligonucleotide
  Target: FXN; (-) strand; PAM type: YTN; PAM sequence: TTA
gatttatgtaactggttatg

SEQ ID NO: 25333 - DNA, 20 bp, Artificial Sequence
  Description of Artificial Sequence: Synthetic oligonucleotide
  Target: FXN; (-) strand; PAM type: YTN; PAM sequence: TTT
agatttatgtaactggttat

SEQ ID NO: 25334 - DNA, 20 bp, Artificial Sequence
  Description of Artificial Sequence: Synthetic oligonucleotide
  Target: FXN; (-) strand; PAM type: YTN; PAM sequence: TTA
atatttagatttatgtaact

SEQ ID NO: 25335 - DNA, 20 bp, Artificial Sequence
  Description of Artificial Sequence: Synthetic oligonucleotide
  Target: FXN; (-) strand; PAM type: YTN; PAM sequence: TTT
aatatttagatttatgtaac

SEQ ID NO: 25336 - DNA, 20 bp, Artificial Sequence
  Description of Artificial Sequence: Synthetic oligonucleotide
  Target: FXN; (-) strand; PAM type: YTN; PAM sequence: TTT
taatatttagatttatgtaa

SEQ ID NO: 25337 - DNA, 20 bp, Artificial Sequence
  Description of Artificial Sequence: Synthetic oligonucleotide
  Target: FXN; (-) strand; PAM type: YTN; PAM sequence: TTT
ttaatatttagatttatgta

SEQ ID NO: 25338 - DNA, 20 bp, Artificial Sequence
  Description of Artificial Sequence: Synthetic oligonucleotide
  Target: FXN; (-) strand; PAM type: YTN; PAM sequence: TTT
tttaatatttagatttatgt

SEQ ID NO: 25339 - DNA, 20 bp, Artificial Sequence
  Description of Artificial Sequence: Synthetic oligonucleotide
  Target: FXN; (-) strand; PAM type: YTN; PAM sequence: TTT
ttttaatatttagatttatg

SEQ ID NO: 25340 - DNA, 20 bp, Artificial Sequence
  Description of Artificial Sequence: Synthetic oligonucleotide
  Target: FXN; (-) strand; PAM type: YTN; PAM sequence: TTG
gagatttttttaatatttag

SEQ ID NO: 25341 - DNA, 20 bp, Artificial Sequence
  Description of Artificial Sequence: Synthetic oligonucleotide
  Target: FXN; (-) strand; PAM type: YTN; PAM sequence: CTA
ttggagatttttttaatatt

SEQ ID NO: 25342 - DNA, 20 bp, Artificial Sequence
  Description of Artificial Sequence: Synthetic oligonucleotide
  Target: FXN; (-) strand; PAM type: YTN; PAM sequence: CTA
aaatctattggagatttttt

SEQ ID NO: 25343 - DNA, 20 bp, Artificial Sequence
  Description of Artificial Sequence: Synthetic oligonucleotide
  Target: FXN; (-) strand; PAM type: YTN; PAM sequence: TTC
acaaagatggtgaatgccat

SEQ ID NO: 25344 - DNA, 20 bp, Artificial Sequence
  Description of Artificial Sequence: Synthetic oligonucleotide
  Target: FXN; (-) strand; PAM type: YTN; PAM sequence: TTT
cacaaagatggtgaatgcca

SEQ ID NO: 25345 - DNA, 20 bp, Artificial Sequence
  Description of Artificial Sequence: Synthetic oligonucleotide
  Target: FXN; (-) strand; PAM type: YTN; PAM sequence: TTT
tcacaaagatggtgaatgcc

SEQ ID NO: 25346 - DNA, 20 bp, Artificial Sequence
  Description of Artificial Sequence: Synthetic oligonucleotide
  Target: FXN; (-) strand; PAM type: YTN; PAM sequence: CTT
ttcacaaagatggtgaatgc

SEQ ID NO: 25347 - DNA, 20 bp, Artificial Sequence
  Description of Artificial Sequence: Synthetic oligonucleotide
  Target: FXN; (-) strand; PAM type: YTN; PAM sequence: TTC
aacttttcacaaagatggtg

SEQ ID NO: 25348 - DNA, 20 bp, Artificial Sequence
  Description of Artificial Sequence: Synthetic oligonucleotide
  Target: FXN; (-) strand; PAM type: YTN; PAM sequence: TTA
gtaatgttcaacttttcaca

SEQ ID NO: 25349 - DNA, 20 bp, Artificial Sequence
  Description of Artificial Sequence: Synthetic oligonucleotide
  Target: FXN; (-) strand; PAM type: YTN; PAM sequence: TTC
attagtaatgttcaactttt

SEQ ID NO: 25350 - DNA, 20 bp, Artificial Sequence
  Description of Artificial Sequence: Synthetic oligonucleotide
  Target: FXN; (-) strand; PAM type: YTN; PAM sequence: TTT
cattagtaatgttcaacttt

SEQ ID NO: 25351 - DNA, 20 bp, Artificial Sequence
  Description of Artificial Sequence: Synthetic oligonucleotide
  Target: FXN; (-) strand; PAM type: YTN; PAM sequence: CTA
aagatatgatcagatttcat

SEQ ID NO: 25352 - DNA, 20 bp, Artificial Sequence
  Description of Artificial Sequence: Synthetic oligonucleotide
  Target: FXN; (-) strand; PAM type: YTN; PAM sequence: TTC
taaagatatgatcagatttc

SEQ ID NO: 25353 - DNA, 20 bp, Artificial Sequence
  Description of Artificial Sequence: Synthetic oligonucleotide
  Target: FXN; (-) strand; PAM type: YTN; PAM sequence: CTT
ctaaagatatgatcagattt

SEQ ID NO: 25354 - DNA, 20 bp, Artificial Sequence
  Description of Artificial Sequence: Synthetic oligonucleotide
  Target: FXN; (-) strand; PAM type: YTN; PAM sequence: TTA
tccttctaaagatatgatca

SEQ ID NO: 25355 - DNA, 20 bp, Artificial Sequence
  Description of Artificial Sequence: Synthetic oligonucleotide
  Target: FXN; (-) strand; PAM type: YTN; PAM sequence: TTT
atccttctaaagatatgatc

SEQ ID NO: 25356 - DNA, 20 bp, Artificial Sequence
  Description of Artificial Sequence: Synthetic oligonucleotide
  Target: FXN; (-) strand; PAM type: YTN; PAM sequence: CTG
tttatccttctaaagatatg

SEQ ID NO: 25357 - DNA, 20 bp, Artificial Sequence
  Description of Artificial Sequence: Synthetic oligonucleotide
  Target: FXN; (-) strand; PAM type: YTN; PAM sequence: CTA
tcactgtttatccttctaaa

SEQ ID NO: 25358 - DNA, 20 bp, Artificial Sequence
  Description of Artificial Sequence: Synthetic oligonucleotide
  Target: FXN; (-) strand; PAM type: YTN; PAM sequence: TTC
agtaaatgctatcactgttt

SEQ ID NO: 25359 - DNA, 20 bp, Artificial Sequence
  Description of Artificial Sequence: Synthetic oligonucleotide
  Target: FXN; (-) strand; PAM type: YTN; PAM sequence: CTG
attcagtaaatgctatcact

SEQ ID NO: 25360 - DNA, 20 bp, Artificial Sequence
  Description of Artificial Sequence: Synthetic oligonucleotide
  Target: FXN; (-) strand; PAM type: YTN; PAM sequence: TTC
tgattcagtaaatgctatca

SEQ ID NO: 25361 - DNA, 20 bp, Artificial Sequence
  Description of Artificial Sequence: Synthetic oligonucleotide
  Target: FXN; (-) strand; PAM type: YTN; PAM sequence: TTA
ttctgattcagtaaatgcta

SEQ ID NO: 25362 - DNA, 20 bp, Artificial Sequence
  Description of Artificial Sequence: Synthetic oligonucleotide
  Target: FXN; (-) strand; PAM type: YTN; PAM sequence: CTC
aaagaaaaccccaaaaaaca

SEQ ID NO: 25363 - DNA, 20 bp, Artificial Sequence
  Description of Artificial Sequence: Synthetic oligonucleotide
  Target: FXN; (-) strand; PAM type: YTN; PAM sequence: CTC
cgtctcaaagaaaaccccaa

SEQ ID NO: 25364 - DNA, 20 bp, Artificial Sequence
  Description of Artificial Sequence: Synthetic oligonucleotide
  Target: FXN; (-) strand; PAM type: YTN; PAM sequence: CTG
ggcaacaagagcaaaactcc

SEQ ID NO: 25365 - DNA, 20 bp, Artificial Sequence
  Description of Artificial Sequence: Synthetic oligonucleotide
  Target: FXN; (-) strand; PAM type: YTN; PAM sequence: CTC
cagcctgggcaacaagagca

SEQ ID NO: 25366 - DNA, 20 bp, Artificial Sequence
  Description of Artificial Sequence: Synthetic oligonucleotide
  Target: FXN; (-) strand; PAM type: YTN; PAM sequence: CTG
cactccagcctgggcaacaa

SEQ ID NO: 25367 - DNA, 20 bp, Artificial Sequence
  Description of Artificial Sequence: Synthetic oligonucleotide
  Target: FXN; (-) strand; PAM type: YTN; PAM sequence: CTG
aggtggcaccactgcactcc

SEQ ID NO: 25368 - DNA, 20 bp, Artificial Sequence
  Description of Artificial Sequence: Synthetic oligonucleotide
  Target: FXN; (-) strand; PAM type: YTN; PAM sequence: TTG
cagtgagctgaggtggcacc

SEQ ID NO: 25369 - DNA, 20 bp, Artificial Sequence
  Description of Artificial Sequence: Synthetic oligonucleotide
  Target: FXN; (-) strand; PAM type: YTN; PAM sequence: TTG
aatccagggggcggaggttg

SEQ ID NO: 25370 - DNA, 20 bp, Artificial Sequence
  Description of Artificial Sequence: Synthetic oligonucleotide
  Target: FXN; (-) strand; PAM type: YTN; PAM sequence: CTT
gaatccagggggcggaggtt

SEQ ID NO: 25371 - DNA, 20 bp, Artificial Sequence
  Description of Artificial Sequence: Synthetic oligonucleotide
  Target: FXN; (-) strand; PAM type: YTN; PAM sequence: CTC
ttgaatccagggggcggagg

SEQ ID NO: 25372 - DNA, 20 bp, Artificial Sequence
  Description of Artificial Sequence: Synthetic oligonucleotide
  Target: FXN; (-) strand; PAM type: YTN; PAM sequence: CTG
aggcaggataatctcttgaa

SEQ ID NO: 25373 - DNA, 20 bp, Artificial Sequence
  Description of Artificial Sequence: Synthetic oligonucleotide
  Target: FXN; (-) strand; PAM type: YTN; PAM sequence: CTC
gggaggctgaggcaggataa

SEQ ID NO: 25374 - DNA, 20 bp, Artificial Sequence
  Description of Artificial Sequence: Synthetic oligonucleotide
  Target: FXN; (-) strand; PAM type: YTN; PAM sequence: CTA
ctcgggaggctgaggcagga

SEQ ID NO: 25375 - DNA, 20 bp, Artificial Sequence
  Description of Artificial Sequence: Synthetic oligonucleotide
  Target: FXN; (-) strand; PAM type: YTN; PAM sequence: CTG
taatcccagctactcgggag

SEQ ID NO: 25376 - DNA, 20 bp, Artificial Sequence
  Description of Artificial Sequence: Synthetic oligonucleotide
  Target: FXN; (-) strand; PAM type: YTN; PAM sequence: CTG
ggcatggtggggcgagcctg

SEQ ID NO: 25377 - DNA, 20 bp, Artificial Sequence
  Description of Artificial Sequence: Synthetic oligonucleotide
  Target: FXN; (-) strand; PAM type: YTN; PAM sequence: TTA
gctgggcatggtggggcgag

SEQ ID NO: 25378 - DNA, 20 bp, Artificial Sequence
  Description of Artificial Sequence: Synthetic oligonucleotide
  Target: FXN; (-) strand; PAM type: YTN; PAM sequence: CTA
aaaatacaaaaattagctgg

SEQ ID NO: 25379 - DNA, 20 bp, Artificial Sequence
  Description of Artificial Sequence: Synthetic oligonucleotide
  Target: FXN; (-) strand; PAM type: YTN; PAM sequence: CTA
ctaaaaatacaaaaattagc

SEQ ID NO: 25380 - DNA, 20 bp, Artificial Sequence
  Description of Artificial Sequence: Synthetic oligonucleotide
  Target: FXN; (-) strand; PAM type: YTN; PAM sequence: CTC
tactaaaaatacaaaaatta

SEQ ID NO: 25381 - DNA, 20 bp, Artificial Sequence
  Description of Artificial Sequence: Synthetic oligonucleotide
  Target: FXN; (-) strand; PAM type: YTN; PAM sequence: CTC
gcctctactaaaaatacaaa

SEQ ID NO: 25382 - DNA, 20 bp, Artificial Sequence
  Description of Artificial Sequence: Synthetic oligonucleotide
  Target: FXN; (-) strand; PAM type: YTN; PAM sequence: CTG
acatggtgaaacctcgcctc

SEQ ID NO: 25383 - DNA, 20 bp, Artificial Sequence
  Description of Artificial Sequence: Synthetic oligonucleotide
  Target: FXN; (-) strand; PAM type: YTN; PAM sequence: CTG
gctgacatggtgaaacctcg

SEQ ID NO: 25384 - DNA, 20 bp, Artificial Sequence
  Description of Artificial Sequence: Synthetic oligonucleotide
  Target: FXN; (-) strand; PAM type: YTN; PAM sequence: TTC
aagaccagcctggctgacat

SEQ ID NO: 25385 - DNA, 20 bp, Artificial Sequence
  Description of Artificial Sequence: Synthetic oligonucleotide
  Target: FXN; (-) strand; PAM type: YTN; PAM sequence: CTG
aggtcaggagttcaagacca

SEQ ID NO: 25386 - DNA, 20 bp, Artificial Sequence
  Description of Artificial Sequence: Synthetic oligonucleotide
  Target: FXN; (-) strand; PAM type: YTN; PAM sequence: CTG
aggcgggtggatcacctgag

SEQ ID NO: 25387 - DNA, 20 bp, Artificial Sequence
  Description of Artificial Sequence: Synthetic oligonucleotide
  Target: FXN; (-) strand; PAM type: YTN; PAM sequence: TTG
ggaggctgaggcgggtggat

SEQ ID NO: 25388 - DNA, 20 bp, Artificial Sequence
  Description of Artificial Sequence: Synthetic oligonucleotide
  Target: FXN; (-) strand; PAM type: YTN; PAM sequence: TTT
gggaggctgaggcgggtgga

SEQ ID NO: 25389 - DNA, 20 bp, Artificial Sequence
  Description of Artificial Sequence: Synthetic oligonucleotide
  Target: FXN; (-) strand; PAM type: YTN; PAM sequence: TTT
tgggaggctgaggcgggtgg

SEQ ID NO: 25390 - DNA, 20 bp, Artificial Sequence
  Description of Artificial Sequence: Synthetic oligonucleotide
  Target: FXN; (-) strand; PAM type: YTN; PAM sequence: CTA
gcattttgggaggctgaggc

SEQ ID NO: 25391 - DNA, 20 bp, Artificial Sequence
  Description of Artificial Sequence: Synthetic oligonucleotide
  Target: FXN; (-) strand; PAM type: YTN; PAM sequence: CTG
taatcctagcattttgggag

SEQ ID NO: 25392 - DNA, 20 bp, Artificial Sequence
  Description of Artificial Sequence: Synthetic oligonucleotide
  Target: FXN; (-) strand; PAM type: YTN; PAM sequence: CTC
acgcctgtaatcctagcatt

SEQ ID NO: 25393 - DNA, 20 bp, Artificial Sequence
  Description of Artificial Sequence: Synthetic oligonucleotide
  Target: FXN; (-) strand; PAM type: YTN; PAM sequence: CTG
gtggctcacgcctgtaatcc

SEQ ID NO: 25394 - DNA, 20 bp, Artificial Sequence
  Description of Artificial Sequence: Synthetic oligonucleotide
  Target: FXN; (-) strand; PAM type: YTN; PAM sequence: CTG
ggcctggtggctcacgcctg

SEQ ID NO: 25395 - DNA, 20 bp, Artificial Sequence
  Description of Artificial Sequence: Synthetic oligonucleotide
  Target: FXN; (-) strand; PAM type: YTN; PAM sequence: CTC
aaaaaaagaaaaaaaaaaaa

SEQ ID NO: 25396 - DNA, 20 bp, Artificial Sequence
  Description of Artificial Sequence: Synthetic oligonucleotide
  Target: FXN; (-) strand; PAM type: YTN; PAM sequence: CTC
cgtctcaaaaaaagaaaaaa

SEQ ID NO: 25397 - DNA, 20 bp, Artificial Sequence
  Description of Artificial Sequence: Synthetic oligonucleotide
  Target: FXN; (-) strand; PAM type: YTN; PAM sequence: CTG
ggtgacagagtgagactccg

SEQ ID NO: 25398 - DNA, 20 bp, Artificial Sequence
  Description of Artificial Sequence: Synthetic oligonucleotide
  Target: FXN; (-) strand; PAM type: YTN; PAM sequence: CTC
cagcctgggtgacagagtga

SEQ ID NO: 25399 - DNA, 20 bp, Artificial Sequence
  Description of Artificial Sequence: Synthetic oligonucleotide
  Target: FXN; (-) strand; PAM type: YTN; PAM sequence: CTG
cactccagcctgggtgacag

SEQ ID NO: 25400 - DNA, 20 bp, Artificial Sequence
  Description of Artificial Sequence: Synthetic oligonucleotide
  Target: FXN; (-) strand; PAM type: YTN; PAM sequence: TTG
tgccactgcactccagcctg

SEQ ID NO: 25401 - DNA, 20 bp, Artificial Sequence
  Description of Artificial Sequence: Synthetic oligonucleotide
  Target: FXN; (-) strand; PAM type: YTN; PAM sequence: CTG
acattgtgccactgcactcc

SEQ ID NO: 25402 - DNA, 20 bp, Artificial Sequence
  Description of Artificial Sequence: Synthetic oligonucleotide
  Target: FXN; (-) strand; PAM type: YTN; PAM sequence: TTG
caatgagctgacattgtgcc

SEQ ID NO: 25403 - DNA, 20 bp, Artificial Sequence
  Description of Artificial Sequence: Synthetic oligonucleotide
  Target: FXN; (-) strand; PAM type: YTN; PAM sequence: CTG
aaaccccggaggtggaggtt

SEQ ID NO: 25404 - DNA, 20 bp, Artificial Sequence
  Description of Artificial Sequence: Synthetic oligonucleotide
  Target: FXN; (-) strand; PAM type: YTN; PAM sequence: CTG
agacaggagaatcactgaaa

SEQ ID NO: 25405 - DNA, 20 bp, Artificial Sequence
  Description of Artificial Sequence: Synthetic oligonucleotide
  Target: FXN; (-) strand; PAM type: YTN; PAM sequence: TTG
ggaggctgagacaggagaat

SEQ ID NO: 25406 - DNA, 20 bp, Artificial Sequence
  Description of Artificial Sequence: Synthetic oligonucleotide
  Target: FXN; (-) strand; PAM type: YTN; PAM sequence: CTT
gggaggctgagacaggagaa

SEQ ID NO: 25407 - DNA, 20 bp, Artificial Sequence
  Description of Artificial Sequence: Synthetic oligonucleotide
  Target: FXN; (-) strand; PAM type: YTN; PAM sequence: CTA
cttgggaggctgagacagga

SEQ ID NO: 25408 - DNA, 20 bp, Artificial Sequence
  Description of Artificial Sequence: Synthetic oligonucleotide
  Target: FXN; (-) strand; PAM type: YTN; PAM sequence: TTC
ccagctacttgggaggctga

SEQ ID NO: 25409 - DNA, 20 bp, Artificial Sequence
  Description of Artificial Sequence: Synthetic oligonucleotide
  Target: FXN; (-) strand; PAM type: YTN; PAM sequence: CTG
tagttcccagctacttggga

SEQ ID NO: 25410 - DNA, 20 bp, Artificial Sequence
  Description of Artificial Sequence: Synthetic oligonucleotide
  Target: FXN; (-) strand; PAM type: YTN; PAM sequence: TTG
tggtgcacgcctgtagttcc

SEQ ID NO: 25411 - DNA, 20 bp, Artificial Sequence
  Description of Artificial Sequence: Synthetic oligonucleotide
  Target: FXN; (-) strand; PAM type: YTN; PAM sequence: CTT
gtggtgcacgcctgtagttc

SEQ ID NO: 25412 - DNA, 20 bp, Artificial Sequence
  Description of Artificial Sequence: Synthetic oligonucleotide
  Target: FXN; (-) strand; PAM type: YTN; PAM sequence: CTG
ggcttgtggtgcacgcctgt

SEQ ID NO: 25413 - DNA, 20 bp, Artificial Sequence
  Description of Artificial Sequence: Synthetic oligonucleotide
  Target: FXN; (-) strand; PAM type: YTN; PAM sequence: TTA
gctgggcttgtggtgcacgc

SEQ ID NO: 25414 - DNA, 20 bp, Artificial Sequence
  Description of Artificial Sequence: Synthetic oligonucleotide
  Target: FXN; (-) strand; PAM type: YTN; PAM sequence: CTA
aaaatacaaaaattagctgg

SEQ ID NO: 25415 - DNA, 20 bp, Artificial Sequence
  Description of Artificial Sequence: Synthetic oligonucleotide
  Target: FXN; (-) strand; PAM type: YTN; PAM sequence: CTA
ctaaaaatacaaaaattagc

SEQ ID NO: 25416 - DNA, 20 bp, Artificial Sequence
  Description of Artificial Sequence: Synthetic oligonucleotide
  Target: FXN; (-) strand; PAM type: YTN; PAM sequence: CTC
tactaaaaatacaaaaatta

SEQ ID NO: 25417 - DNA, 20 bp, Artificial Sequence
  Description of Artificial Sequence: Synthetic oligonucleotide
  Target: FXN; (-) strand; PAM type: YTN; PAM sequence: CTG
tctctactaaaaatacaaaa

SEQ ID NO: 25418 - DNA, 20 bp, Artificial Sequence
  Description of Artificial Sequence: Synthetic oligonucleotide
  Target: FXN; (-) strand; PAM type: YTN; PAM sequence: CTA
gccaggccaatatggcaaaa

SEQ ID NO: 25419 - DNA, 20 bp, Artificial Sequence
  Description of Artificial Sequence: Synthetic oligonucleotide
  Target: FXN; (-) strand; PAM type: YTN; PAM sequence: TTG
aaactagccaggccaatatg

SEQ ID NO: 25420 - DNA, 20 bp, Artificial Sequence
  Description of Artificial Sequence: Synthetic oligonucleotide
  Target: FXN; (-) strand; PAM type: YTN; PAM sequence: TTT
gaaactagccaggccaatat

SEQ ID NO: 25421 - DNA, 20 bp, Artificial Sequence
  Description of Artificial Sequence: Synthetic oligonucleotide
  Target: FXN; (-) strand; PAM type: YTN; PAM sequence: CTG
aggtcaggagtttgaaacta

SEQ ID NO: 25422 - DNA, 20 bp, Artificial Sequence
  Description of Artificial Sequence: Synthetic oligonucleotide
  Target: FXN; (-) strand; PAM type: YTN; PAM sequence: CTC
acctgaggtcaggagtttga

SEQ ID NO: 25423 - DNA, 20 bp, Artificial Sequence
  Description of Artificial Sequence: Synthetic oligonucleotide
  Target: FXN; (-) strand; PAM type: YTN; PAM sequence: TTC
ggaggccgaggtaggtggct

SEQ ID NO: 25424 - DNA, 20 bp, Artificial Sequence
  Description of Artificial Sequence: Synthetic oligonucleotide
  Target: FXN; (-) strand; PAM type: YTN; PAM sequence: TTT
cggaggccgaggtaggtggc

SEQ ID NO: 25425 - DNA, 20 bp, Artificial Sequence
  Description of Artificial Sequence: Synthetic oligonucleotide
  Target: FXN; (-) strand; PAM type: YTN; PAM sequence: CTT
tcggaggccgaggtaggtgg

SEQ ID NO: 25426 - DNA, 20 bp, Artificial Sequence
  Description of Artificial Sequence: Synthetic oligonucleotide
  Target: FXN; (-) strand; PAM type: YTN; PAM sequence: CTG
taatcccaggactttcggag

SEQ ID NO: 25427 - DNA, 20 bp, Artificial Sequence
  Description of Artificial Sequence: Synthetic oligonucleotide
  Target: FXN; (-) strand; PAM type: YTN; PAM sequence: CTC
acgtctgtaatcccaggact

SEQ ID NO: 25428 - DNA, 20 bp, Artificial Sequence
  Description of Artificial Sequence: Synthetic oligonucleotide
  Target: FXN; (-) strand; PAM type: YTN; PAM sequence: CTG
ggccaggcagtgcagtggct

SEQ ID NO: 25429 - DNA, 20 bp, Artificial Sequence
  Description of Artificial Sequence: Synthetic oligonucleotide
  Target: FXN; (-) strand; PAM type: YTN; PAM sequence: TTC
tgggccaggcagtgcagtgg

SEQ ID NO: 25430 - DNA, 20 bp, Artificial Sequence
  Description of Artificial Sequence: Synthetic oligonucleotide
  Target: FXN; (-) strand; PAM type: YTN; PAM sequence: TTT
ctgggccaggcagtgcagtg

SEQ ID NO: 25431 - DNA, 20 bp, Artificial Sequence
  Description of Artificial Sequence: Synthetic oligonucleotide
  Target: FXN; (-) strand; PAM type: YTN; PAM sequence: CTT
tctgggccaggcagtgcagt

SEQ ID NO: 25432 - DNA, 20 bp, Artificial Sequence
  Description of Artificial Sequence: Synthetic oligonucleotide
  Target: FXN; (-) strand; PAM type: YTN; PAM sequence: TTA
atagtcctttctgggccagg

SEQ ID NO: 25433 - DNA, 20 bp, Artificial Sequence
  Description of Artificial Sequence: Synthetic oligonucleotide
  Target: FXN; (-) strand; PAM type: YTN; PAM sequence: CTA
caattaatagtcctttctgg

SEQ ID NO: 25434 - DNA, 20 bp, Artificial Sequence
  Description of Artificial Sequence: Synthetic oligonucleotide
  Target: FXN; (-) strand; PAM type: YTN; PAM sequence: TTC
ccagaggcaactacaattaa

SEQ ID NO: 25435 - DNA, 20 bp, Artificial Sequence
  Description of Artificial Sequence: Synthetic oligonucleotide
  Target: FXN; (-) strand; PAM type: YTN; PAM sequence: TTA
cagaaagaagcaggcagccc

SEQ ID NO: 25436 - DNA, 20 bp, Artificial Sequence
  Description of Artificial Sequence: Synthetic oligonucleotide
  Target: FXN; (-) strand; PAM type: YTN; PAM sequence: TTA
aacagcacagaaggggttac

SEQ ID NO: 25437 - DNA, 20 bp, Artificial Sequence
  Description of Artificial Sequence: Synthetic oligonucleotide
  Target: FXN; (-) strand; PAM type: YTN; PAM sequence: TTT
aaacagcacagaaggggtta

SEQ ID NO: 25438 - DNA, 20 bp, Artificial Sequence
  Description of Artificial Sequence: Synthetic oligonucleotide
  Target: FXN; (-) strand; PAM type: YTN; PAM sequence: CTC
aaaaaaaaaaaaaaaaaaaa

SEQ ID NO: 25439 - DNA, 20 bp, Artificial Sequence
  Description of Artificial Sequence: Synthetic oligonucleotide
  Target: FXN; (-) strand; PAM type: YTN; PAM sequence: CTG
tctcaaaaaaaaaaaaaaaa

SEQ ID NO: 25440 - DNA, 20 bp, Artificial Sequence
  Description of Artificial Sequence: Synthetic oligonucleotide
  Target: FXN; (-) strand; PAM type: YTN; PAM sequence: CTC
tgtctcaaaaaaaaaaaaaa

SEQ ID NO: 25441 - DNA, 20 bp, Artificial Sequence
  Description of Artificial Sequence: Synthetic oligonucleotide
  Target: FXN; (-) strand; PAM type: YTN; PAM sequence: CTG
ggcgacagagcgagactctg

SEQ ID NO: 25442 - DNA, 20 bp, Artificial Sequence
  Description of Artificial Sequence: Synthetic oligonucleotide
  Target: FXN; (-) strand; PAM type: YTN; PAM sequence: CTC
cagcctgggcgacagagcga

SEQ ID NO: 25443 - DNA, 20 bp, Artificial Sequence
  Description of Artificial Sequence: Synthetic oligonucleotide
  Target: FXN; (-) strand; PAM type: YTN; PAM sequence: CTG
cactccagcctgggcgacag

SEQ ID NO: 25444 - DNA, 20 bp, Artificial Sequence
  Description of Artificial Sequence: Synthetic oligonucleotide
  Target: FXN; (-) strand; PAM type: YTN; PAM sequence: TTG
cgccactgcactccagcctg

SEQ ID NO: 25445 - DNA, 20 bp, Artificial Sequence
  Description of Artificial Sequence: Synthetic oligonucleotide
  Target: FXN; (-) strand; PAM type: YTN; PAM sequence: TTG
cagtgagccgagattgcgcc

SEQ ID NO: 25446 - DNA, 20 bp, Artificial Sequence
  Description of Artificial Sequence: Synthetic oligonucleotide
  Target: FXN; (-) strand; PAM type: YTN; PAM sequence: CTT
gcagtgagccgagattgcgc

SEQ ID NO: 25447 - DNA, 20 bp, Artificial Sequence
  Description of Artificial Sequence: Synthetic oligonucleotide
  Target: FXN; (-) strand; PAM type: YTN; PAM sequence: CTG
ggaggcggagcttgcagtga

SEQ ID NO: 25448 - DNA, 20 bp, Artificial Sequence
  Description of Artificial Sequence: Synthetic oligonucleotide
  Target: FXN; (-) strand; PAM type: YTN; PAM sequence: CTG
aggcaggagaatggcgtgaa

SEQ ID NO: 25449 - DNA, 20 bp, Artificial Sequence
  Description of Artificial Sequence: Synthetic oligonucleotide
  Target: FXN; (-) strand; PAM type: YTN; PAM sequence: CTC
aggaggctgaggcaggagaa

SEQ ID NO: 25450 - DNA, 20 bp, Artificial Sequence
  Description of Artificial Sequence: Synthetic oligonucleotide
  Target: FXN; (-) strand; PAM type: YTN; PAM sequence: CTA
ctcaggaggctgaggcagga

SEQ ID NO: 25451 - DNA, 20 bp, Artificial Sequence
  Description of Artificial Sequence: Synthetic oligonucleotide
  Target: FXN; (-) strand; PAM type: YTN; PAM sequence: CTG
tagtcccagctactcaggag

SEQ ID NO: 25452 - DNA, 20 bp, Artificial Sequence
  Description of Artificial Sequence: Synthetic oligonucleotide
  Target: FXN; (-) strand; PAM type: YTN; PAM sequence: TTA
gccgggcgtggtgacgggtg

SEQ ID NO: 25453 - DNA, 20 bp, Artificial Sequence
  Description of Artificial Sequence: Synthetic oligonucleotide
  Target: FXN; (-) strand; PAM type: YTN; PAM sequence: CTG
aaaatacaaaaaattagccg

SEQ ID NO: 25454 - DNA, 20 bp, Artificial Sequence
  Description of Artificial Sequence: Synthetic oligonucleotide
  Target: FXN; (-) strand; PAM type: YTN; PAM sequence: CTA
ctgaaaatacaaaaaattag

SEQ ID NO: 25455 - DNA, 20 bp, Artificial Sequence
  Description of Artificial Sequence: Synthetic oligonucleotide
  Target: FXN; (-) strand; PAM type: YTN; PAM sequence: CTC
tactgaaaatacaaaaaatt

SEQ ID NO: 25456 - DNA, 20 bp, Artificial Sequence
  Description of Artificial Sequence: Synthetic oligonucleotide
  Target: FXN; (-) strand; PAM type: YTN; PAM sequence: CTA
acatggtgaaaccccgtctc

SEQ ID NO: 25457 - DNA, 20 bp, Artificial Sequence
  Description of Artificial Sequence: Synthetic oligonucleotide
  Target: FXN; (-) strand; PAM type: YTN; PAM sequence: CTG
gctaacatggtgaaaccccg

SEQ ID NO: 25458 - DNA, 20 bp, Artificial Sequence
  Description of Artificial Sequence: Synthetic oligonucleotide
  Target: FXN; (-) strand; PAM type: YTN; PAM sequence: CTG
ggaggccgaggcaggcagat

SEQ ID NO: 25459 - DNA, 20 bp, Artificial Sequence
  Description of Artificial Sequence: Synthetic oligonucleotide
  Target: FXN; (-) strand; PAM type: YTN; PAM sequence: CTC
tgggaggccgaggcaggcag

SEQ ID NO: 25460 - DNA, 20 bp, Artificial Sequence
  Description of Artificial Sequence: Synthetic oligonucleotide
  Target: FXN; (-) strand; PAM type: YTN; PAM sequence: CTG
taatcccagcactctgggag

SEQ ID NO: 25461 - DNA, 20 bp, Artificial Sequence
  Description of Artificial Sequence: Synthetic oligonucleotide
  Target: FXN; (-) strand; PAM type: YTN; PAM sequence: CTC
atgcctgtaatcccagcact

SEQ ID NO: 25462 - DNA, 20 bp, Artificial Sequence
  Description of Artificial Sequence: Synthetic oligonucleotide
  Target: FXN; (-) strand; PAM type: YTN; PAM sequence: TTA
aaggccgggcgtggtagctc

SEQ ID NO: 25463 - DNA, 20 bp, Artificial Sequence
  Description of Artificial Sequence: Synthetic oligonucleotide
  Target: FXN; (-) strand; PAM type: YTN; PAM sequence: TTT
aaaggccgggcgtggtagct

SEQ ID NO: 25464 - DNA, 20 bp, Artificial Sequence
  Description of Artificial Sequence: Synthetic oligonucleotide
  Target: FXN; (-) strand; PAM type: YTN; PAM sequence: TTA
caggcgtaaggcaccgtgcc

SEQ ID NO: 25465 - DNA, 20 bp, Artificial Sequence
  Description of Artificial Sequence: Synthetic oligonucleotide
  Target: FXN; (-) strand; PAM type: YTN; PAM sequence: TTA
ggattacaggcgtaaggcac

SEQ ID NO: 25466 - DNA, 20 bp, Artificial Sequence
  Description of Artificial Sequence: Synthetic oligonucleotide
  Target: FXN; (-) strand; PAM type: YTN; PAM sequence: CTC
gaaatgttaggattacaggc

SEQ ID NO: 25467 - DNA, 20 bp, Artificial Sequence
  Description of Artificial Sequence: Synthetic oligonucleotide
  Target: FXN; (-) strand; PAM type: YTN; PAM sequence: TTC
tcgaaatgttaggattacag

SEQ ID NO: 25468 - DNA, 20 bp, Artificial Sequence
  Description of Artificial Sequence: Synthetic oligonucleotide
  Target: FXN; (-) strand; PAM type: YTN; PAM sequence: CTT
ctcgaaatgttaggattaca

SEQ ID NO: 25469 - DNA, 20 bp, Artificial Sequence
  Description of Artificial Sequence: Synthetic oligonucleotide
  Target: FXN; (-) strand; PAM type: YTN; PAM sequence: CTC
agcttctcgaaatgttagga

SEQ ID NO: 25470 - DNA, 20 bp, Artificial Sequence
  Description of Artificial Sequence: Synthetic oligonucleotide
  Target: FXN; (-) strand; PAM type: YTN; PAM sequence: CTC
gtgacatcaagtgatccacc

SEQ ID NO: 25471 - DNA, 20 bp, Artificial Sequence
  Description of Artificial Sequence: Synthetic oligonucleotide
  Target: FXN; (-) strand; PAM type: YTN; PAM sequence: CTG
aactcgtgacatcaagtgat

SEQ ID NO: 25472 - DNA, 20 bp, Artificial Sequence
  Description of Artificial Sequence: Synthetic oligonucleotide
  Target: FXN; (-) strand; PAM type: YTN; PAM sequence: CTG
gtctgaactcgtgacatcaa

SEQ ID NO: 25473 - DNA, 20 bp, Artificial Sequence
  Description of Artificial Sequence: Synthetic oligonucleotide
  Target: FXN; (-) strand; PAM type: YTN; PAM sequence: CTG
gagtgcagtggctggtctga

SEQ ID NO: 25474 - DNA, 20 bp, Artificial Sequence
  Description of Artificial Sequence: Synthetic oligonucleotide
  Target: FXN; (-) strand; PAM type: YTN; PAM sequence: CTG
tcacccaggctggagtgcag

SEQ ID NO: 25475 - DNA, 20 bp, Artificial Sequence
  Description of Artificial Sequence: Synthetic oligonucleotide
  Target: FXN; (-) strand; PAM type: YTN; PAM sequence: CTC
tgtcacccaggctggagtgc

SEQ ID NO: 25476 - DNA, 20 bp, Artificial Sequence
  Description of Artificial Sequence: Synthetic oligonucleotide
  Target: FXN; (-) strand; PAM type: YTN; PAM sequence: CTC
actctgtcacccaggctgga

SEQ ID NO: 25477 - DNA, 20 bp, Artificial Sequence
  Description of Artificial Sequence: Synthetic oligonucleotide
  Target: FXN; (-) strand; PAM type: YTN; PAM sequence: TTG
agacagagtctcactctgtc

SEQ ID NO: 25478 - DNA, 20 bp, Artificial Sequence
  Description of Artificial Sequence: Synthetic oligonucleotide
  Target: FXN; (-) strand; PAM type: YTN; PAM sequence: TTT
gagacagagtctcactctgt

SEQ ID NO: 25479 - DNA, 20 bp, Artificial Sequence
  Description of Artificial Sequence: Synthetic oligonucleotide
  Target: FXN; (-) strand; PAM type: YTN; PAM sequence: TTT
tgagacagagtctcactctg

SEQ ID NO: 25480 - DNA, 20 bp, Artificial Sequence
  Description of Artificial Sequence: Synthetic oligonucleotide
  Target: FXN; (-) strand; PAM type: YTN; PAM sequence: TTT
ttgagacagagtctcactct

SEQ ID NO: 25481 - DNA, 20 bp, Artificial Sequence
  Description of Artificial Sequence: Synthetic oligonucleotide
  Target: FXN; (-) strand; PAM type: YTN; PAM sequence: TTT
tttgagacagagtctcactc

SEQ ID NO: 25482 - DNA, 20 bp, Artificial Sequence
  Description of Artificial Sequence: Synthetic oligonucleotide
  Target: FXN; (-) strand; PAM type: YTN; PAM sequence: TTT
ttttgagacagagtctcact

SEQ ID NO: 25483 - DNA, 20 bp, Artificial Sequence
  Description of Artificial Sequence: Synthetic oligonucleotide
  Target: FXN; (-) strand; PAM type: YTN; PAM sequence: TTT
tttttgagacagagtctcac

SEQ ID NO: 25484 - DNA, 20 bp, Artificial Sequence
  Description of Artificial Sequence: Synthetic oligonucleotide
  Target: FXN; (-) strand; PAM type: YTN; PAM sequence: TTT
ttttttgagacagagtctca

SEQ ID NO: 25485 - DNA, 20 bp, Artificial Sequence
  Description of Artificial Sequence: Synthetic oligonucleotide
  Target: FXN; (-) strand; PAM type: YTN; PAM sequence: TTT
tttttttgagacagagtctc

SEQ ID NO: 25486 - DNA, 20 bp, Artificial Sequence
  Description of Artificial Sequence: Synthetic oligonucleotide
  Target: FXN; (-) strand; PAM type: YTN; PAM sequence: TTT
ttttttttgagacagagtct

SEQ ID NO: 25487 - DNA, 20 bp, Artificial Sequence
  Description of Artificial Sequence: Synthetic oligonucleotide
  Target: FXN; (-) strand; PAM type: YTN; PAM sequence: TTT
tttttttttgagacagagtc

SEQ ID NO: 25488 - DNA, 20 bp, Artificial Sequence
  Description of Artificial Sequence: Synthetic oligonucleotide
  Target: FXN; (-) strand; PAM type: YTN; PAM sequence: TTT
ttttttttttgagacagagt

SEQ ID NO: 25489 - DNA, 20 bp, Artificial Sequence
  Description of Artificial Sequence: Synthetic oligonucleotide
  Target: FXN; (-) strand; PAM type: YTN; PAM sequence: TTT
tttttttttttgagacagag

SEQ ID NO: 25490 - DNA, 20 bp, Artificial Sequence
  Description of Artificial Sequence: Synthetic oligonucleotide
  Target: FXN; (-) strand; PAM type: YTN; PAM sequence: TTT
ttttttttttttgagacaga

SEQ ID NO: 25491 - DNA, 20 bp, Artificial Sequence
  Description of Artificial Sequence: Synthetic oligonucleotide
  Target: FXN; (-) strand; PAM type: YTN; PAM sequence: TTT
tttttttttttttgagacag

SEQ ID NO: 25492 - DNA, 20 bp, Artificial Sequence
  Description of Artificial Sequence: Synthetic oligonucleotide
  Target: FXN; (-) strand; PAM type: YTN; PAM sequence: CTT
ttttttttttttttgagaca

SEQ ID NO: 25493 - DNA, 20 bp, Artificial Sequence
  Description of Artificial Sequence: Synthetic oligonucleotide
  Target: FXN; (-) strand; PAM type: YTN; PAM sequence: TTC
ttttttttttttttttgaga

SEQ ID NO: 25494 - DNA, 20 bp, Artificial Sequence
  Description of Artificial Sequence: Synthetic oligonucleotide
  Target: FXN; (-) strand; PAM type: YTN; PAM sequence: TTT
cttttttttttttttttgag

SEQ ID NO: 25495 - DNA, 20 bp, Artificial Sequence
  Description of Artificial Sequence: Synthetic oligonucleotide
  Target: FXN; (-) strand; PAM type: YTN; PAM sequence: CTT
tcttttttttttttttttga

SEQ ID NO: 25496 - DNA, 20 bp, Artificial Sequence
  Description of Artificial Sequence: Synthetic oligonucleotide
  Target: FXN; (-) strand; PAM type: YTN; PAM sequence: TTC
tttctttttttttttttttt

SEQ ID NO: 25497 - DNA, 20 bp, Artificial Sequence
  Description of Artificial Sequence: Synthetic oligonucleotide
  Target: FXN; (-) strand; PAM type: YTN; PAM sequence: TTT
ctttcttttttttttttttt

SEQ ID NO: 25498 - DNA, 20 bp, Artificial Sequence
  Description of Artificial Sequence: Synthetic oligonucleotide
  Target: FXN; (-) strand; PAM type: YTN; PAM sequence: TTT
tctttctttttttttttttt

SEQ ID NO: 25499 - DNA, 20 bp, Artificial Sequence
  Description of Artificial Sequence: Synthetic oligonucleotide
  Target: FXN; (-) strand; PAM type: YTN; PAM sequence: TTT
ttctttcttttttttttttt

SEQ ID NO: 25500 - DNA, 20 bp, Artificial Sequence
  Description of Artificial Sequence: Synthetic oligonucleotide
  Target: FXN; (-) strand; PAM type: YTN; PAM sequence: TTG
atgaaaataacatgtaaaaa

SEQ ID NO: 25501 - DNA, 20 bp, Artificial Sequence
  Description of Artificial Sequence: Synthetic oligonucleotide
  Target: FXN; (-) strand; PAM type: YTN; PAM sequence: TTA
aattgatgaaaataacatgt

SEQ ID NO: 25502 - DNA, 20 bp, Artificial Sequence
  Description of Artificial Sequence: Synthetic oligonucleotide
  Target: FXN; (-) strand; PAM type: YTN; PAM sequence: TTC
attaaattgatgaaaataac

SEQ ID NO: 25503 - DNA, 20 bp, Artificial Sequence
  Description of Artificial Sequence: Synthetic oligonucleotide
  Target: FXN; (-) strand; PAM type: YTN; PAM sequence: TTA
aattcattaaattgatgaaa

SEQ ID NO: 25504 - DNA, 20 bp, Artificial Sequence
  Description of Artificial Sequence: Synthetic oligonucleotide
  Target: FXN; (-) strand; PAM type: YTN; PAM sequence: TTT
aaattcattaaattgatgaa

SEQ ID NO: 25505 - DNA, 20 bp, Artificial Sequence
  Description of Artificial Sequence: Synthetic oligonucleotide
  Target: FXN; (-) strand; PAM type: YTN; PAM sequence: TTA
tttaaattcattaaattgat

SEQ ID NO: 25506 - DNA, 20 bp, Artificial Sequence
  Description of Artificial Sequence: Synthetic oligonucleotide
  Target: FXN; (-) strand; PAM type: YTN; PAM sequence: TTG
ttatttaaattcattaaatt

SEQ ID NO: 25507 - DNA, 20 bp, Artificial Sequence
  Description of Artificial Sequence: Synthetic oligonucleotide
  Target: FXN; (-) strand; PAM type: YTN; PAM sequence: TTT
gttatttaaattcattaaat

SEQ ID NO: 25508 - DNA, 20 bp, Artificial Sequence
  Description of Artificial Sequence: Synthetic oligonucleotide
  Target: FXN; (-) strand; PAM type: YTN; PAM sequence: TTA
tacatttgttatttaaattc

SEQ ID NO: 25509 - DNA, 20 bp, Artificial Sequence
  Description of Artificial Sequence: Synthetic oligonucleotide
  Target: FXN; (-) strand; PAM type: YTN; PAM sequence: TTT
atacatttgttatttaaatt

SEQ ID NO: 25510 - DNA, 20 bp, Artificial Sequence
  Description of Artificial Sequence: Synthetic oligonucleotide
  Target: FXN; (-) strand; PAM type: YTN; PAM sequence: TTA
atatcaaatttatacatttg

SEQ ID NO: 25511 - DNA, 20 bp, Artificial Sequence
  Description of Artificial Sequence: Synthetic oligonucleotide
  Target: FXN; (-) strand; PAM type: YTN; PAM sequence: TTA
ttaatatcaaatttatacat

SEQ ID NO: 25512 - DNA, 20 bp, Artificial Sequence
  Description of Artificial Sequence: Synthetic oligonucleotide
  Target: FXN; (-) strand; PAM type: YTN; PAM sequence: TTT
attaatatcaaatttataca

SEQ ID NO: 25513 - DNA, 20 bp, Artificial Sequence
  Description of Artificial Sequence: Synthetic oligonucleotide
  Target: FXN; (-) strand; PAM type: YTN; PAM sequence: TTT
tattaatatcaaatttatac

SEQ ID NO: 25514 - DNA, 20 bp, Artificial Sequence
  Description of Artificial Sequence: Synthetic oligonucleotide
  Target: FXN; (-) strand; PAM type: YTN; PAM sequence: TTC
cattttattaatatcaaatt

SEQ ID NO: 25515 - DNA, 20 bp, Artificial Sequence
  Description of Artificial Sequence: Synthetic oligonucleotide
  Target: FXN; (-) strand; PAM type: YTN; PAM sequence: CTT
ccattttattaatatcaaat

SEQ ID NO: 25516 - DNA, 20 bp, Artificial Sequence
  Description of Artificial Sequence: Synthetic oligonucleotide
  Target: FXN; (-) strand; PAM type: YTN; PAM sequence: TTA
ccaaatgcttccattttatt

SEQ ID NO: 25517 - DNA, 20 bp, Artificial Sequence
  Description of Artificial Sequence: Synthetic oligonucleotide
  Target: FXN; (-) strand; PAM type: YTN; PAM sequence: CTG
cagaggaagcacaaaaccca

SEQ ID NO: 25518 - DNA, 20 bp, Artificial Sequence
  Description of Artificial Sequence: Synthetic oligonucleotide
  Target: FXN; (-) strand; PAM type: YTN; PAM sequence: CTA
gagagctgcagaggaagcac

SEQ ID NO: 25519 - DNA, 20 bp, Artificial Sequence
  Description of Artificial Sequence: Synthetic oligonucleotide
  Target: FXN; (-) strand; PAM type: YTN; PAM sequence: CTC
atctagagagctgcagagga

SEQ ID NO: 25520 - DNA, 20 bp, Artificial Sequence
  Description of Artificial Sequence: Synthetic oligonucleotide
  Target: FXN; (-) strand; PAM type: YTN; PAM sequence: TTC
ataggtggtctcatctagag

SEQ ID NO: 25521 - DNA, 20 bp, Artificial Sequence
  Description of Artificial Sequence: Synthetic oligonucleotide
  Target: FXN; (-) strand; PAM type: YTN; PAM sequence: TTT
cataggtggtctcatctaga

SEQ ID NO: 25522 - DNA, 20 bp, Artificial Sequence
  Description of Artificial Sequence: Synthetic oligonucleotide
  Target: FXN; (-) strand; PAM type: YTN; PAM sequence: CTT
tcataggtggtctcatctag

SEQ ID NO: 25523 - DNA, 20 bp, Artificial Sequence
  Description of Artificial Sequence: Synthetic oligonucleotide
  Target: FXN; (-) strand; PAM type: YTN; PAM sequence: CTA
gtctttcataggtggtctca

SEQ ID NO: 25524 - DNA, 20 bp, Artificial Sequence
  Description of Artificial Sequence: Synthetic oligonucleotide
  Target: FXN; (-) strand; PAM type: YTN; PAM sequence: CTG
ctagtctttcataggtggtc

SEQ ID NO: 25525 - DNA, 20 bp, Artificial Sequence
  Description of Artificial Sequence: Synthetic oligonucleotide
  Target: FXN; (-) strand; PAM type: YTN; PAM sequence: CTC
tgctagtctttcataggtgg

SEQ ID NO: 25526 - DNA, 20 bp, Artificial Sequence
  Description of Artificial Sequence: Synthetic oligonucleotide
  Target: FXN; (-) strand; PAM type: YTN; PAM sequence: TTC
ctctgctagtctttcatagg

SEQ ID NO: 25527 - DNA, 20 bp, Artificial Sequence
  Description of Artificial Sequence: Synthetic oligonucleotide
  Target: FXN; (-) strand; PAM type: YTN; PAM sequence: TTT
cctctgctagtctttcatag

SEQ ID NO: 25528 - DNA, 20 bp, Artificial Sequence
  Description of Artificial Sequence: Synthetic oligonucleotide
  Target: FXN; (-) strand; PAM type: YTN; PAM sequence: CTA
aagagtccagcgtttcctct

SEQ ID NO: 25529 - DNA, 20 bp, Artificial Sequence
  Description of Artificial Sequence: Synthetic oligonucleotide
  Target: FXN; (-) strand; PAM type: YTN; PAM sequence: CTG
ctaaagagtccagcgtttcc

SEQ ID NO: 25530 - DNA, 20 bp, Artificial Sequence
  Description of Artificial Sequence: Synthetic oligonucleotide
  Target: FXN; (-) strand; PAM type: YTN; PAM sequence: CTC
tgctaaagagtccagcgttt

SEQ ID NO: 25531 - DNA, 20 bp, Artificial Sequence
  Description of Artificial Sequence: Synthetic oligonucleotide
  Target: FXN; (-) strand; PAM type: YTN; PAM sequence: TTC
aaaaaactctgctaaagagt

SEQ ID NO: 25532 - DNA, 20 bp, Artificial Sequence
  Description of Artificial Sequence: Synthetic oligonucleotide
  Target: FXN; (-) strand; PAM type: YTN; PAM sequence: CTT
caaaaaactctgctaaagag

SEQ ID NO: 25533 - DNA, 20 bp, Artificial Sequence
  Description of Artificial Sequence: Synthetic oligonucleotide
  Target: FXN; (-) strand; PAM type: YTN; PAM sequence: CTG
caaggtcttcaaaaaactct

SEQ ID NO: 25534 - DNA, 20 bp, Artificial Sequence
  Description of Artificial Sequence: Synthetic oligonucleotide
  Target: FXN; (-) strand; PAM type: YTN; PAM sequence: TTG
tctgcaaggtcttcaaaaaa

SEQ ID NO: 25535 - DNA, 20 bp, Artificial Sequence
  Description of Artificial Sequence: Synthetic oligonucleotide
  Target: FXN; (-) strand; PAM type: YTN; PAM sequence: CTT
gtctgcaaggtcttcaaaaa

SEQ ID NO: 25536 - DNA, 20 bp, Artificial Sequence
  Description of Artificial Sequence: Synthetic oligonucleotide
  Target: FXN; (-) strand; PAM type: YTN; PAM sequence: CTC
aaacgtgtatggcttgtctg

SEQ ID NO: 25537 - DNA, 20 bp, Artificial Sequence
  Description of Artificial Sequence: Synthetic oligonucleotide
  Target: FXN; (-) strand; PAM type: YTN; PAM sequence: TTA
gagggggaaacagaaaaata

SEQ ID NO: 25538 - DNA, 20 bp, Artificial Sequence
  Description of Artificial Sequence: Synthetic oligonucleotide
  Target: FXN; (-) strand; PAM type: YTN; PAM sequence: CTT
agagggggaaacagaaaaat

SEQ ID NO: 25539 - DNA, 20 bp, Artificial Sequence
  Description of Artificial Sequence: Synthetic oligonucleotide
  Target: FXN; (-) strand; PAM type: YTN; PAM sequence: TTC
ttagagggggaaacagaaaa

SEQ ID NO: 25540 - DNA, 20 bp, Artificial Sequence
  Description of Artificial Sequence: Synthetic oligonucleotide
  Target: FXN; (-) strand; PAM type: YTN; PAM sequence: CTA
aaattcttagagggggaaac

SEQ ID NO: 25541 - DNA, 20 bp, Artificial Sequence
  Description of Artificial Sequence: Synthetic oligonucleotide
  Target: FXN; (-) strand; PAM type: YTN; PAM sequence: TTA
gtgaactaaaattcttagag

SEQ ID NO: 25542 - DNA, 20 bp, Artificial Sequence
  Description of Artificial Sequence: Synthetic oligonucleotide
  Target: FXN; (-) strand; PAM type: YTN; PAM sequence: TTT
agtgaactaaaattcttaga

SEQ ID NO: 25543 - DNA, 20 bp, Artificial Sequence
  Description of Artificial Sequence: Synthetic oligonucleotide
  Target: FXN; (-) strand; PAM type: YTN; PAM sequence: TTT
tagtgaactaaaattcttag

SEQ ID NO: 25544 - DNA, 20 bp, Artificial Sequence
  Description of Artificial Sequence: Synthetic oligonucleotide
  Target: FXN; (-) strand; PAM type: YTN; PAM sequence: TTC
attttagtgaactaaaattc

SEQ ID NO: 25545 - DNA, 20 bp, Artificial Sequence
  Description of Artificial Sequence: Synthetic oligonucleotide
  Target: FXN; (-) strand; PAM type: YTN; PAM sequence: CTT
cattttagtgaactaaaatt

SEQ ID NO: 25546 - DNA, 20 bp, Artificial Sequence
  Description of Artificial Sequence: Synthetic oligonucleotide
  Target: FXN; (-) strand; PAM type: YTN; PAM sequence: TTC
ttcattttagtgaactaaaa

SEQ ID NO: 25547 - DNA, 20 bp, Artificial Sequence
  Description of Artificial Sequence: Synthetic oligonucleotide
  Target: FXN; (-) strand; PAM type: YTN; PAM sequence: CTG
gagggaaattcttcatttta

SEQ ID NO: 25548 - DNA, 20 bp, Artificial Sequence
  Description of Artificial Sequence: Synthetic oligonucleotide
  Target: FXN; (-) strand; PAM type: YTN; PAM sequence: CTG
ctggagggaaattcttcatt

SEQ ID NO: 25549 - DNA, 20 bp, Artificial Sequence
  Description of Artificial Sequence: Synthetic oligonucleotide
  Target: FXN; (-) strand; PAM type: YTN; PAM sequence: CTC
tgctggagggaaattcttca

SEQ ID NO: 25550 - DNA, 20 bp, Artificial Sequence
  Description of Artificial Sequence: Synthetic oligonucleotide
  Target: FXN; (-) strand; PAM type: YTN; PAM sequence: TTA
gctctgctggagggaaattc

SEQ ID NO: 25551 - DNA, 20 bp, Artificial Sequence
  Description of Artificial Sequence: Synthetic oligonucleotide
  Target: FXN; (-) strand; PAM type: YTN; PAM sequence: CTT
agctctgctggagggaaatt

SEQ ID NO: 25552 - DNA, 20 bp, Artificial Sequence
  Description of Artificial Sequence: Synthetic oligonucleotide
  Target: FXN; (-) strand; PAM type: YTN; PAM sequence: TTG
atgcttagctctgctggagg

SEQ ID NO: 25553 - DNA, 20 bp, Artificial Sequence
  Description of Artificial Sequence: Synthetic oligonucleotide
  Target: FXN; (-) strand; PAM type: YTN; PAM sequence: CTT
gatgcttagctctgctggag

SEQ ID NO: 25554 - DNA, 20 bp, Artificial Sequence
  Description of Artificial Sequence: Synthetic oligonucleotide
  Target: FXN; (-) strand; PAM type: YTN; PAM sequence: CTA
cttgatgcttagctctgctg

SEQ ID NO: 25555 - DNA, 20 bp, Artificial Sequence
  Description of Artificial Sequence: Synthetic oligonucleotide
  Target: FXN; (-) strand; PAM type: YTN; PAM sequence: CTA
catgctacttgatgcttagc

SEQ ID NO: 25556 - DNA, 20 bp, Artificial Sequence
  Description of Artificial Sequence: Synthetic oligonucleotide
  Target: FXN; (-) strand; PAM type: YTN; PAM sequence: CTA
caactacatgctacttgatg

SEQ ID NO: 25557 - DNA, 20 bp, Artificial Sequence
  Description of Artificial Sequence: Synthetic oligonucleotide
  Target: FXN; (-) strand; PAM type: YTN; PAM sequence: CTA
cctacaactacatgctactt

SEQ ID NO: 25558 - DNA, 20 bp, Artificial Sequence
  Description of Artificial Sequence: Synthetic oligonucleotide
  Target: FXN; (-) strand; PAM type: YTN; PAM sequence: TTA
atcctacctacaactacatg

SEQ ID NO: 25559 - DNA, 20 bp, Artificial Sequence
  Description of Artificial Sequence: Synthetic oligonucleotide
  Target: FXN; (-) strand; PAM type: YTN; PAM sequence: TTT
aatcctacctacaactacat

SEQ ID NO: 25560 - DNA, 20 bp, Artificial Sequence
  Description of Artificial Sequence: Synthetic oligonucleotide
  Target: FXN; (-) strand; PAM type: YTN; PAM sequence: TTT
taatcctacctacaactaca

SEQ ID NO: 25561 - DNA, 20 bp, Artificial Sequence
  Description of Artificial Sequence: Synthetic oligonucleotide
  Target: FXN; (-) strand; PAM type: YTN; PAM sequence: CTT
ttaatcctacctacaactac

SEQ ID NO: 25562 - DNA, 20 bp, Artificial Sequence
  Description of Artificial Sequence: Synthetic oligonucleotide
  Target: FXN; (-) strand; PAM type: YTN; PAM sequence: CTA
gtcttttaatcctacctaca

SEQ ID NO: 25563 - DNA, 20 bp, Artificial Sequence
  Description of Artificial Sequence: Synthetic oligonucleotide
  Target: FXN; (-) strand; PAM type: YTN; PAM sequence: CTC
ccggaaccctagtcttttaa

SEQ ID NO: 25564 - DNA, 20 bp, Artificial Sequence
  Description of Artificial Sequence: Synthetic oligonucleotide
  Target: FXN; (-) strand; PAM type: YTN; PAM sequence: TTC
acctcccggaaccctagtct

SEQ ID NO: 25565 - DNA, 20 bp, Artificial Sequence
  Description of Artificial Sequence: Synthetic oligonucleotide
  Target: FXN; (-) strand; PAM type: YTN; PAM sequence: CTT
cacctcccggaaccctagtc

SEQ ID NO: 25566 - DNA, 20 bp, Artificial Sequence
  Description of Artificial Sequence: Synthetic oligonucleotide
  Target: FXN; (-) strand; PAM type: YTN; PAM sequence: CTG
caaccttcacctcccggaac

SEQ ID NO: 25567 - DNA, 20 bp, Artificial Sequence
  Description of Artificial Sequence: Synthetic oligonucleotide
  Target: FXN; (-) strand; PAM type: YTN; PAM sequence: CTC
actgcaaccttcacctcccg

SEQ ID NO: 25568 - DNA, 20 bp, Artificial Sequence
  Description of Artificial Sequence: Synthetic oligonucleotide
  Target: FXN; (-) strand; PAM type: YTN; PAM sequence: TTG
gctcactgcaaccttcacct

SEQ ID NO: 25569 - DNA, 20 bp, Artificial Sequence
  Description of Artificial Sequence: Synthetic oligonucleotide
  Target: FXN; (-) strand; PAM type: YTN; PAM sequence: TTT
ggctcactgcaaccttcacc

SEQ ID NO: 25570 - DNA, 20 bp, Artificial Sequence
  Description of Artificial Sequence: Synthetic oligonucleotide
  Target: FXN; (-) strand; PAM type: YTN; PAM sequence: TTT
tggctcactgcaaccttcac

SEQ ID NO: 25571 - DNA, 20 bp, Artificial Sequence
  Description of Artificial Sequence: Synthetic oligonucleotide
  Target: FXN; (-) strand; PAM type: YTN; PAM sequence: CTG
gagtgcagtggcgtgatttt

SEQ ID NO: 25572 - DNA, 20 bp, Artificial Sequence
  Description of Artificial Sequence: Synthetic oligonucleotide
  Target: FXN; (-) strand; PAM type: YTN; PAM sequence: CTG
tcacccaggctggagtgcag

SEQ ID NO: 25573 - DNA, 20 bp, Artificial Sequence
  Description of Artificial Sequence: Synthetic oligonucleotide
  Target: FXN; (-) strand; PAM type: YTN; PAM sequence: CTC
tgtcacccaggctggagtgc

SEQ ID NO: 25574 - DNA, 20 bp, Artificial Sequence
  Description of Artificial Sequence: Synthetic oligonucleotide
  Target: FXN; (-) strand; PAM type: YTN; PAM sequence: CTC
gctctgtcacccaggctgga

SEQ ID NO: 25575 - DNA, 20 bp, Artificial Sequence
  Description of Artificial Sequence: Synthetic oligonucleotide
  Target: FXN; (-) strand; PAM type: YTN; PAM sequence: CTA
tgacagagtctcgctctgtc

SEQ ID NO: 25576 - DNA, 20 bp, Artificial Sequence
  Description of Artificial Sequence: Synthetic oligonucleotide
  Target: FXN; (-) strand; PAM type: YTN; PAM sequence: CTA
tccatccatccatccatcca

SEQ ID NO: 25577 - DNA, 20 bp, Artificial Sequence
  Description of Artificial Sequence: Synthetic oligonucleotide
  Target: FXN; (-) strand; PAM type: YTN; PAM sequence: CTA
tctatccatccatccatcca

SEQ ID NO: 25578 - DNA, 20 bp, Artificial Sequence
  Description of Artificial Sequence: Synthetic oligonucleotide
  Target: FXN; (-) strand; PAM type: YTN; PAM sequence: CTA
tctatctatccatccatcca

SEQ ID NO: 25579 - DNA, 20 bp, Artificial Sequence
  Description of Artificial Sequence: Synthetic oligonucleotide
  Target: FXN; (-) strand; PAM type: YTN; PAM sequence: CTA
tctatctatctatccatcca

SEQ ID NO: 25580 - DNA, 20 bp, Artificial Sequence
  Description of Artificial Sequence: Synthetic oligonucleotide
  Target: FXN; (-) strand; PAM type: YTN; PAM sequence: CTA
tctatctatctatctatcca

SEQ ID NO: 25581 - DNA, 20 bp, Artificial Sequence
  Description of Artificial Sequence: Synthetic oligonucleotide
  Target: FXN; (-) strand; PAM type: YTN; PAM sequence: CTA
tctatctatctatctatcta

SEQ ID NO: 25582 - DNA, 20 bp, Artificial Sequence
  Description of Artificial Sequence: Synthetic oligonucleotide
  Target: FXN; (-) strand; PAM type: YTN; PAM sequence: CTA
tctatctatctatctatcta

SEQ ID NO: 25583 - DNA, 20 bp, Artificial Sequence
  Description of Artificial Sequence: Synthetic oligonucleotide
  Target: FXN; (-) strand; PAM type: YTN; PAM sequence: CTA
tccagctatctatctatcta

SEQ ID NO: 25584 - DNA, 20 bp, Artificial Sequence
  Description of Artificial Sequence: Synthetic oligonucleotide
  Target: FXN; (-) strand; PAM type: YTN; PAM sequence: CTA
tctatccagctatctatcta

SEQ ID NO: 25585 - DNA, 20 bp, Artificial Sequence
  Description of Artificial Sequence: Synthetic oligonucleotide
  Target: FXN; (-) strand; PAM type: YTN; PAM sequence: TTA
tctatctatccagctatcta

SEQ ID NO: 25586 - DNA, 20 bp, Artificial Sequence
  Description of Artificial Sequence: Synthetic oligonucleotide
  Target: FXN; (-) strand; PAM type: YTN; PAM sequence: CTT
atctatctatccagctatct

SEQ ID NO: 25587 - DNA, 20 bp, Artificial Sequence
  Description of Artificial Sequence: Synthetic oligonucleotide
  Target: FXN; (-) strand; PAM type: YTN; PAM sequence: CTA
tcttatctatctatccagct

SEQ ID NO: 25588 - DNA, 20 bp, Artificial Sequence
  Description of Artificial Sequence: Synthetic oligonucleotide
  Target: FXN; (-) strand; PAM type: YTN; PAM sequence: TTA
tctatcttatctatctatcc

SEQ ID NO: 25589 - DNA, 20 bp, Artificial Sequence
  Description of Artificial Sequence: Synthetic oligonucleotide
  Target: FXN; (-) strand; PAM type: YTN; PAM sequence: CTT
atctatcttatctatctatc

SEQ ID NO: 25590 - DNA, 20 bp, Artificial Sequence
  Description of Artificial Sequence: Synthetic oligonucleotide
  Target: FXN; (-) strand; PAM type: YTN; PAM sequence: TTG
tcttatctatcttatctatc

SEQ ID NO: 25591 - DNA, 20 bp, Artificial Sequence
  Description of Artificial Sequence: Synthetic oligonucleotide
  Target: FXN; (-) strand; PAM type: YTN; PAM sequence: CTT
gtcttatctatcttatctat

SEQ ID NO: 25592 - DNA, 20 bp, Artificial Sequence
  Description of Artificial Sequence: Synthetic oligonucleotide
  Target: FXN; (-) strand; PAM type: YTN; PAM sequence: CTA
gtcttgtcttatctatctta

SEQ ID NO: 25593 - DNA, 20 bp, Artificial Sequence
  Description of Artificial Sequence: Synthetic oligonucleotide
  Target: FXN; (-) strand; PAM type: YTN; PAM sequence: TTG
aagcctagtcttgtcttatc

SEQ ID NO: 25594 - DNA, 20 bp, Artificial Sequence
  Description of Artificial Sequence: Synthetic oligonucleotide
  Target: FXN; (-) strand; PAM type: YTN; PAM sequence: CTT
gaagcctagtcttgtcttat

SEQ ID NO: 25595 - DNA, 20 bp, Artificial Sequence
  Description of Artificial Sequence: Synthetic oligonucleotide
  Target: FXN; (-) strand; PAM type: YTN; PAM sequence: CTG
cagcttgaagcctagtcttg

SEQ ID NO: 25596 - DNA, 20 bp, Artificial Sequence
  Description of Artificial Sequence: Synthetic oligonucleotide
  Target: FXN; (-) strand; PAM type: YTN; PAM sequence: CTG
gactgcagcttgaagcctag

SEQ ID NO: 25597 - DNA, 20 bp, Artificial Sequence
  Description of Artificial Sequence: Synthetic oligonucleotide
  Target: FXN; (-) strand; PAM type: YTN; PAM sequence: CTG
gtagagctggactgcagctt

SEQ ID NO: 25598 - DNA, 20 bp, Artificial Sequence
  Description of Artificial Sequence: Synthetic oligonucleotide
  Target: FXN; (-) strand; PAM type: YTN; PAM sequence: TTG
cccagagtcacaacaagcct

SEQ ID NO: 25599 - DNA, 20 bp, Artificial Sequence
  Description of Artificial Sequence: Synthetic oligonucleotide
  Target: FXN; (-) strand; PAM type: YTN; PAM sequence: CTT
gcccagagtcacaacaagcc

SEQ ID NO: 25600 - DNA, 20 bp, Artificial Sequence
  Description of Artificial Sequence: Synthetic oligonucleotide
  Target: FXN; (-) strand; PAM type: YTN; PAM sequence: CTG
agtgacttgcccagagtcac

SEQ ID NO: 25601 - DNA, 20 bp, Artificial Sequence
  Description of Artificial Sequence: Synthetic oligonucleotide
  Target: FXN; (-) strand; PAM type: YTN; PAM sequence: CTC
agagaggctgagtgacttgc

SEQ ID NO: 25602 - DNA, 20 bp, Artificial Sequence
  Description of Artificial Sequence: Synthetic oligonucleotide
  Target: FXN; (-) strand; PAM type: YTN; PAM sequence: CTG
gaaaatgaggctcagagagg

SEQ ID NO: 25603 - DNA, 20 bp, Artificial Sequence
  Description of Artificial Sequence: Synthetic oligonucleotide
  Target: FXN; (-) strand; PAM type: YTN; PAM sequence: CTG
aagctggaaaatgaggctca

SEQ ID NO: 25604 - DNA, 20 bp, Artificial Sequence
  Description of Artificial Sequence: Synthetic oligonucleotide
  Target: FXN; (-) strand; PAM type: YTN; PAM sequence: TTC
atgggtatccactgaagctg

SEQ ID NO: 25605 - DNA, 20 bp, Artificial Sequence
  Description of Artificial Sequence: Synthetic oligonucleotide
  Target: FXN; (-) strand; PAM type: YTN; PAM sequence: CTT
catgggtatccactgaagct

SEQ ID NO: 25606 - DNA, 20 bp, Artificial Sequence
  Description of Artificial Sequence: Synthetic oligonucleotide
  Target: FXN; (-) strand; PAM type: YTN; PAM sequence: TTG
ccttcatgggtatccactga

SEQ ID NO: 25607 - DNA, 20 bp, Artificial Sequence
  Description of Artificial Sequence: Synthetic oligonucleotide
  Target: FXN; (-) strand; PAM type: YTN; PAM sequence: TTT
gccttcatgggtatccactg

SEQ ID NO: 25608 - DNA, 20 bp, Artificial Sequence
  Description of Artificial Sequence: Synthetic oligonucleotide
  Target: FXN; (-) strand; PAM type: YTN; PAM sequence: CTG
atttgccttcatgggtatcc

SEQ ID NO: 25609 - DNA, 20 bp, Artificial Sequence
  Description of Artificial Sequence: Synthetic oligonucleotide
  Target: FXN; (-) strand; PAM type: YTN; PAM sequence: CTC
tgatttgccttcatgggtat

SEQ ID NO: 25610 - DNA, 20 bp, Artificial Sequence
  Description of Artificial Sequence: Synthetic oligonucleotide
  Target: FXN; (-) strand; PAM type: YTN; PAM sequence: CTC
tctgatttgccttcatgggt

SEQ ID NO: 25611 - DNA, 20 bp, Artificial Sequence
  Description of Artificial Sequence: Synthetic oligonucleotide
  Target: FXN; (-) strand; PAM type: YTN; PAM sequence: CTC
aggcccctctctgatttgcc

SEQ ID NO: 25612 - DNA, 20 bp, Artificial Sequence
  Description of Artificial Sequence: Synthetic oligonucleotide
  Target: FXN; (-) strand; PAM type: YTN; PAM sequence: CTG
gacaaatacacactcaggcc

SEQ ID NO: 25613 - DNA, 20 bp, Artificial Sequence
  Description of Artificial Sequence: Synthetic oligonucleotide
  Target: FXN; (-) strand; PAM type: YTN; PAM sequence: CTG
ctggacaaatacacactcag

SEQ ID NO: 25614 - DNA, 20 bp, Artificial Sequence
  Description of Artificial Sequence: Synthetic oligonucleotide
  Target: FXN; (-) strand; PAM type: YTN; PAM sequence: CTG
cctgctggacaaatacacac

SEQ ID NO: 25615 - DNA, 20 bp, Artificial Sequence
  Description of Artificial Sequence: Synthetic oligonucleotide
  Target: FXN; (-) strand; PAM type: YTN; PAM sequence: CTC
catctgcctgctggacaaat

SEQ ID NO: 25616 - DNA, 20 bp, Artificial Sequence
  Description of Artificial Sequence: Synthetic oligonucleotide
  Target: FXN; (-) strand; PAM type: YTN; PAM sequence: TTC
cctccatctgcctgctggac

SEQ ID NO: 25617 - DNA, 20 bp, Artificial Sequence
  Description of Artificial Sequence: Synthetic oligonucleotide
  Target: FXN; (-) strand; PAM type: YTN; PAM sequence: TTG
ttccctccatctgcctgctg

SEQ ID NO: 25618 - DNA, 20 bp, Artificial Sequence
  Description of Artificial Sequence: Synthetic oligonucleotide
  Target: FXN; (-) strand; PAM type: YTN; PAM sequence: TTG
ttgttccctccatctgcctg

SEQ ID NO: 25619 - DNA, 20 bp, Artificial Sequence
  Description of Artificial Sequence: Synthetic oligonucleotide
  Target: FXN; (-) strand; PAM type: YTN; PAM sequence: TTT
gttgttccctccatctgcct

SEQ ID NO: 25620 - DNA, 20 bp, Artificial Sequence
  Description of Artificial Sequence: Synthetic oligonucleotide
  Target: FXN; (-) strand; PAM type: YTN; PAM sequence: CTA
gtttgttgttccctccatct

SEQ ID NO: 25621 - DNA, 20 bp, Artificial Sequence
  Description of Artificial Sequence: Synthetic oligonucleotide
  Target: FXN; (-) strand; PAM type: YTN; PAM sequence: CTA
cgggtctagtttgttgttcc

SEQ ID NO: 25622 - DNA, 20 bp, Artificial Sequence
  Description of Artificial Sequence: Synthetic oligonucleotide
  Target: FXN; (-) strand; PAM type: YTN; PAM sequence: CTG
aagaactacgggtctagttt

SEQ ID NO: 25623 - DNA, 20 bp, Artificial Sequence
  Description of Artificial Sequence: Synthetic oligonucleotide
  Target: FXN; (-) strand; PAM type: YTN; PAM sequence: CTA
ctgaagaactacgggtctag

SEQ ID NO: 25624 - DNA, 20 bp, Artificial Sequence
  Description of Artificial Sequence: Synthetic oligonucleotide
  Target: FXN; (-) strand; PAM type: YTN; PAM sequence: TTA
tccctactgaagaactacgg

SEQ ID NO: 25625 - DNA, 20 bp, Artificial Sequence
  Description of Artificial Sequence: Synthetic oligonucleotide
  Target: FXN; (-) strand; PAM type: YTN; PAM sequence: CTT
atccctactgaagaactacg

SEQ ID NO: 25626 - DNA, 20 bp, Artificial Sequence
  Description of Artificial Sequence: Synthetic oligonucleotide
  Target: FXN; (-) strand; PAM type: YTN; PAM sequence: TTA
tcttatccctactgaagaac

SEQ ID NO: 25627 - DNA, 20 bp, Artificial Sequence
  Description of Artificial Sequence: Synthetic oligonucleotide
  Target: FXN; (-) strand; PAM type: YTN; PAM sequence: TTG
ggcagttatcttatccctac

SEQ ID NO: 25628 - DNA, 20 bp, Artificial Sequence
  Description of Artificial Sequence: Synthetic oligonucleotide
  Target: FXN; (-) strand; PAM type: YTN; PAM sequence: TTT
gggcagttatcttatcccta

SEQ ID NO: 25629 - DNA, 20 bp, Artificial Sequence
  Description of Artificial Sequence: Synthetic oligonucleotide
  Target: FXN; (-) strand; PAM type: YTN; PAM sequence: TTT
tgggcagttatcttatccct

SEQ ID NO: 25630 - DNA, 20 bp, Artificial Sequence
  Description of Artificial Sequence: Synthetic oligonucleotide
  Target: FXN; (-) strand; PAM type: YTN; PAM sequence: CTT
ttgggcagttatcttatccc

SEQ ID NO: 25631 - DNA, 20 bp, Artificial Sequence
  Description of Artificial Sequence: Synthetic oligonucleotide
  Target: FXN; (-) strand; PAM type: YTN; PAM sequence: CTA
aataacttttgggcagttat

SEQ ID NO: 25632 - DNA, 20 bp, Artificial Sequence
  Description of Artificial Sequence: Synthetic oligonucleotide
  Target: FXN; (-) strand; PAM type: YTN; PAM sequence: TTG
taatctaaataacttttggg

SEQ ID NO: 25633 - DNA, 20 bp, Artificial Sequence
  Description of Artificial Sequence: Synthetic oligonucleotide
  Target: FXN; (-) strand; PAM type: YTN; PAM sequence: TTT
gtaatctaaataacttttgg

SEQ ID NO: 25634 - DNA, 20 bp, Artificial Sequence
  Description of Artificial Sequence: Synthetic oligonucleotide
  Target: FXN; (-) strand; PAM type: YTN; PAM sequence: CTT
tgtaatctaaataacttttg

SEQ ID NO: 25635 - DNA, 20 bp, Artificial Sequence
  Description of Artificial Sequence: Synthetic oligonucleotide
  Target: FXN; (-) strand; PAM type: YTN; PAM sequence: CTC
aagtctttgtaatctaaata

SEQ ID NO: 25636 - DNA, 20 bp, Artificial Sequence
  Description of Artificial Sequence: Synthetic oligonucleotide
  Target: FXN; (-) strand; PAM type: YTN; PAM sequence: CTC
acaggagcagggctcaagtc

SEQ ID NO: 25637 - DNA, 20 bp, Artificial Sequence
  Description of Artificial Sequence: Synthetic oligonucleotide
  Target: FXN; (-) strand; PAM type: YTN; PAM sequence: CTG
tctcacaggagcagggctca

SEQ ID NO: 25638 - DNA, 20 bp, Artificial Sequence
  Description of Artificial Sequence: Synthetic oligonucleotide
  Target: FXN; (-) strand; PAM type: YTN; PAM sequence: CTA
ccccatcactgtctcacagg

SEQ ID NO: 25639 - DNA, 20 bp, Artificial Sequence
  Description of Artificial Sequence: Synthetic oligonucleotide
  Target: FXN; (-) strand; PAM type: YTN; PAM sequence: TTC
ccaggaatgcacccgaccta

SEQ ID NO: 25640 - DNA, 20 bp, Artificial Sequence
  Description of Artificial Sequence: Synthetic oligonucleotide
  Target: FXN; (-) strand; PAM type: YTN; PAM sequence: CTT
cccaggaatgcacccgacct

SEQ ID NO: 25641 - DNA, 20 bp, Artificial Sequence
  Description of Artificial Sequence: Synthetic oligonucleotide
  Target: FXN; (-) strand; PAM type: YTN; PAM sequence: TTC
aaaaatatgcttcccaggaa

SEQ ID NO: 25642 - DNA, 20 bp, Artificial Sequence
  Description of Artificial Sequence: Synthetic oligonucleotide
  Target: FXN; (-) strand; PAM type: YTN; PAM sequence: TTT
caaaaatatgcttcccagga

SEQ ID NO: 25643 - DNA, 20 bp, Artificial Sequence
  Description of Artificial Sequence: Synthetic oligonucleotide
  Target: FXN; (-) strand; PAM type: YTN; PAM sequence: TTT
tcaaaaatatgcttcccagg

SEQ ID NO: 25644 - DNA, 20 bp, Artificial Sequence
  Description of Artificial Sequence: Synthetic oligonucleotide
  Target: FXN; (-) strand; PAM type: YTN; PAM sequence: CTT
ttcaaaaatatgcttcccag

SEQ ID NO: 25645 - DNA, 20 bp, Artificial Sequence
  Description of Artificial Sequence: Synthetic oligonucleotide
  Target: FXN; (-) strand; PAM type: YTN; PAM sequence: TTA
gaatcccaggtgagcttttc

SEQ ID NO: 25646 - DNA, 20 bp, Artificial Sequence
  Description of Artificial Sequence: Synthetic oligonucleotide
  Target: FXN; (-) strand; PAM type: YTN; PAM sequence: CTA
gggatacacattagaatccc

SEQ ID NO: 25647 - DNA, 20 bp, Artificial Sequence
  Description of Artificial Sequence: Synthetic oligonucleotide
  Target: FXN; (-) strand; PAM type: YTN; PAM sequence: CTA
ggaataagacctagggatac

SEQ ID NO: 25648 - DNA, 20 bp, Artificial Sequence
  Description of Artificial Sequence: Synthetic oligonucleotide
  Target: FXN; (-) strand; PAM type: YTN; PAM sequence: CTC
taggaataagacctagggat

SEQ ID NO: 25649 - DNA, 20 bp, Artificial Sequence
  Description of Artificial Sequence: Synthetic oligonucleotide
  Target: FXN; (-) strand; PAM type: YTN; PAM sequence: CTG
cccaggtcatgccacacccc

SEQ ID NO: 25650 - DNA, 20 bp, Artificial Sequence
  Description of Artificial Sequence: Synthetic oligonucleotide
  Target: FXN; (-) strand; PAM type: YTN; PAM sequence: TTA
aaaatcccagtgccctgccc

SEQ ID NO: 25651 - DNA, 20 bp, Artificial Sequence
  Description of Artificial Sequence: Synthetic oligonucleotide
  Target: FXN; (-) strand; PAM type: YTN; PAM sequence: CTT
aaaaatcccagtgccctgcc

SEQ ID NO: 25652 - DNA, 20 bp, Artificial Sequence
  Description of Artificial Sequence: Synthetic oligonucleotide
  Target: FXN; (-) strand; PAM type: YTN; PAM sequence: CTG
tggagcttaaaaatcccagt

SEQ ID NO: 25653 - DNA, 20 bp, Artificial Sequence
  Description of Artificial Sequence: Synthetic oligonucleotide
  Target: FXN; (-) strand; PAM type: YTN; PAM sequence: TTG
gaatcatctgtggagcttaa

SEQ ID NO: 25654 - DNA, 20 bp, Artificial Sequence
  Description of Artificial Sequence: Synthetic oligonucleotide
  Target: FXN; (-) strand; PAM type: YTN; PAM sequence: CTG
catattggaatcatctgtgg

SEQ ID NO: 25655 - DNA, 20 bp, Artificial Sequence
  Description of Artificial Sequence: Synthetic oligonucleotide
  Target: FXN; (-) strand; PAM type: YTN; PAM sequence: CTA
gctgcatattggaatcatct

SEQ ID NO: 25656 - DNA, 20 bp, Artificial Sequence
  Description of Artificial Sequence: Synthetic oligonucleotide
  Target: FXN; (-) strand; PAM type: YTN; PAM sequence: CTC
atactagctgcatattggaa

SEQ ID NO: 25657 - DNA, 20 bp, Artificial Sequence
  Description of Artificial Sequence: Synthetic oligonucleotide
  Target: FXN; (-) strand; PAM type: YTN; PAM sequence: TTC
tcatactagctgcatattgg

SEQ ID NO: 25658 - DNA, 20 bp, Artificial Sequence
  Description of Artificial Sequence: Synthetic oligonucleotide
  Target: FXN; (-) strand; PAM type: YTN; PAM sequence: TTC
aaaaaaaaacaagttctcat

SEQ ID NO: 25659 - DNA, 20 bp, Artificial Sequence
  Description of Artificial Sequence: Synthetic oligonucleotide
  Target: FXN; (-) strand; PAM type: YTN; PAM sequence: CTT
caaaaaaaaacaagttctca

SEQ ID NO: 25660 - DNA, 20 bp, Artificial Sequence
  Description of Artificial Sequence: Synthetic oligonucleotide
  Target: FXN; (-) strand; PAM type: YTN; PAM sequence: CTC
cttcaaaaaaaaacaagttc

SEQ ID NO: 25661 - DNA, 20 bp, Artificial Sequence
  Description of Artificial Sequence: Synthetic oligonucleotide
  Target: FXN; (-) strand; PAM type: YTN; PAM sequence: CTG
ggtgacagagtgagactcct

SEQ ID NO: 25662 - DNA, 20 bp, Artificial Sequence
  Description of Artificial Sequence: Synthetic oligonucleotide
  Target: FXN; (-) strand; PAM type: YTN; PAM sequence: CTC
cagcctgggtgacagagtga

SEQ ID NO: 25663 - DNA, 20 bp, Artificial Sequence
  Description of Artificial Sequence: Synthetic oligonucleotide
  Target: FXN; (-) strand; PAM type: YTN; PAM sequence: CTG
cactccagcctgggtgacag

SEQ ID NO: 25664 - DNA, 20 bp, Artificial Sequence
  Description of Artificial Sequence: Synthetic oligonucleotide
  Target: FXN; (-) strand; PAM type: YTN; PAM sequence: TTG
cgccactgcactccagcctg

SEQ ID NO: 25665 - DNA, 20 bp, Artificial Sequence
  Description of Artificial Sequence: Synthetic oligonucleotide
  Target: FXN; (-) strand; PAM type: YTN; PAM sequence: TTG
aacccaggaagcggagcagt

SEQ ID NO: 25666 - DNA, 20 bp, Artificial Sequence
  Description of Artificial Sequence: Synthetic oligonucleotide
  Target: FXN; (-) strand; PAM type: YTN; PAM sequence: CTT
gaacccaggaagcggagcag

SEQ ID NO: 25667 - DNA, 20 bp, Artificial Sequence
  Description of Artificial Sequence: Synthetic oligonucleotide
  Target: FXN; (-) strand; PAM type: YTN; PAM sequence: CTG
cttgaacccaggaagcggag

SEQ ID NO: 25668 - DNA, 20 bp, Artificial Sequence
  Description of Artificial Sequence: Synthetic oligonucleotide
  Target: FXN; (-) strand; PAM type: YTN; PAM sequence: CTG
aggcaggagaactgcttgaa

SEQ ID NO: 25669 - DNA, 20 bp, Artificial Sequence
  Description of Artificial Sequence: Synthetic oligonucleotide
  Target: FXN; (-) strand; PAM type: YTN; PAM sequence: CTC
gggaggctgaggcaggagaa

SEQ ID NO: 25670 - DNA, 20 bp, Artificial Sequence
  Description of Artificial Sequence: Synthetic oligonucleotide
  Target: FXN; (-) strand; PAM type: YTN; PAM sequence: CTA
ctcgggaggctgaggcagga

SEQ ID NO: 25671 - DNA, 20 bp, Artificial Sequence
  Description of Artificial Sequence: Synthetic oligonucleotide
  Target: FXN; (-) strand; PAM type: YTN; PAM sequence: CTA
taatcccagctactcgggag

SEQ ID NO: 25672 - DNA, 20 bp, Artificial Sequence
  Description of Artificial Sequence: Synthetic oligonucleotide
  Target: FXN; (-) strand; PAM type: YTN; PAM sequence: CTG
ggcatggtggcagatgccta

SEQ ID NO: 25673 - DNA, 20 bp, Artificial Sequence
  Description of Artificial Sequence: Synthetic oligonucleotide
  Target: FXN; (-) strand; PAM type: YTN; PAM sequence: TTA
gctgggcatggtggcagatg

SEQ ID NO: 25674 - DNA, 20 bp, Artificial Sequence
  Description of Artificial Sequence: Synthetic oligonucleotide
  Target: FXN; (-) strand; PAM type: YTN; PAM sequence: CTA
aaatgcaaaaattagctggg

SEQ ID NO: 25675 - DNA, 20 bp, Artificial Sequence
  Description of Artificial Sequence: Synthetic oligonucleotide
  Target: FXN; (-) strand; PAM type: YTN; PAM sequence: TTA
ctaaaatgcaaaaattagct

SEQ ID NO: 25676 - DNA, 20 bp, Artificial Sequence
  Description of Artificial Sequence: Synthetic oligonucleotide
  Target: FXN; (-) strand; PAM type: YTN; PAM sequence: TTT
actaaaatgcaaaaattagc

SEQ ID NO: 25677 - DNA, 20 bp, Artificial Sequence
  Description of Artificial Sequence: Synthetic oligonucleotide
  Target: FXN; (-) strand; PAM type: YTN; PAM sequence: CTT
tactaaaatgcaaaaattag

SEQ ID NO: 25678 - DNA, 20 bp, Artificial Sequence
  Description of Artificial Sequence: Synthetic oligonucleotide
  Target: FXN; (-) strand; PAM type: YTN; PAM sequence: CTA
accaacatggtgaaaccccg

SEQ ID NO: 25679 - DNA, 20 bp, Artificial Sequence
  Description of Artificial Sequence: Synthetic oligonucleotide
  Target: FXN; (-) strand; PAM type: YTN; PAM sequence: TTG
aggtcaggagatcgagacca

SEQ ID NO: 25680 - DNA, 20 bp, Artificial Sequence
  Description of Artificial Sequence: Synthetic oligonucleotide
  Target: FXN; (-) strand; PAM type: YTN; PAM sequence: TTT
gaggtcaggagatcgagacc

SEQ ID NO: 25681 - DNA, 20 bp, Artificial Sequence
  Description of Artificial Sequence: Synthetic oligonucleotide
  Target: FXN; (-) strand; PAM type: YTN; PAM sequence: CTG
atgggggtggaccatttgag

SEQ ID NO: 25682 - DNA, 20 bp, Artificial Sequence
  Description of Artificial Sequence: Synthetic oligonucleotide
  Target: FXN; (-) strand; PAM type: YTN; PAM sequence: TTG
gaaggctgatgggggtggac

SEQ ID NO: 25683 - DNA, 20 bp, Artificial Sequence
  Description of Artificial Sequence: Synthetic oligonucleotide
  Target: FXN; (-) strand; PAM type: YTN; PAM sequence: TTT
ggaaggctgatgggggtgga

SEQ ID NO: 25684 - DNA, 20 bp, Artificial Sequence
  Description of Artificial Sequence: Synthetic oligonucleotide
  Target: FXN; (-) strand; PAM type: YTN; PAM sequence: CTT
tggaaggctgatgggggtgg

SEQ ID NO: 25685 - DNA, 20 bp, Artificial Sequence
  Description of Artificial Sequence: Synthetic oligonucleotide
  Target: FXN; (-) strand; PAM type: YTN; PAM sequence: TTA
tcccaaaactttggaaggct

SEQ ID NO: 25686 - DNA, 20 bp, Artificial Sequence
  Description of Artificial Sequence: Synthetic oligonucleotide
  Target: FXN; (-) strand; PAM type: YTN; PAM sequence: CTG
ttatcccaaaactttggaag

SEQ ID NO: 25687 - DNA, 20 bp, Artificial Sequence
  Description of Artificial Sequence: Synthetic oligonucleotide
  Target: FXN; (-) strand; PAM type: YTN; PAM sequence: CTC
acgcctgttatcccaaaact

SEQ ID NO: 25688 - DNA, 20 bp, Artificial Sequence
  Description of Artificial Sequence: Synthetic oligonucleotide
  Target: FXN; (-) strand; PAM type: YTN; PAM sequence: CTG
gtggctcacgcctgttatcc

SEQ ID NO: 25689 - DNA, 20 bp, Artificial Sequence
  Description of Artificial Sequence: Synthetic oligonucleotide
  Target: FXN; (-) strand; PAM type: YTN; PAM sequence: CTC
acaccaggccggacctggtg

SEQ ID NO: 25690 - DNA, 20 bp, Artificial Sequence
  Description of Artificial Sequence: Synthetic oligonucleotide
  Target: FXN; (-) strand; PAM type: YTN; PAM sequence: TTC
tcacaccaggccggacctgg

SEQ ID NO: 25691 - DNA, 20 bp, Artificial Sequence
  Description of Artificial Sequence: Synthetic oligonucleotide
  Target: FXN; (-) strand; PAM type: YTN; PAM sequence: CTC
agaagttctcacaccaggcc

SEQ ID NO: 25692 - DNA, 20 bp, Artificial Sequence
  Description of Artificial Sequence: Synthetic oligonucleotide
  Target: FXN; (-) strand; PAM type: YTN; PAM sequence: TTC
atccaactcagaagttctca

SEQ ID NO: 25693 - DNA, 20 bp, Artificial Sequence
  Description of Artificial Sequence: Synthetic oligonucleotide
  Target: FXN; (-) strand; PAM type: YTN; PAM sequence: TTT
catccaactcagaagttctc

SEQ ID NO: 25694 - DNA, 20 bp, Artificial Sequence
  Description of Artificial Sequence: Synthetic oligonucleotide
  Target: FXN; (-) strand; PAM type: YTN; PAM sequence: CTA
atgtttcatccaactcagaa

SEQ ID NO: 25695 - DNA, 20 bp, Artificial Sequence
  Description of Artificial Sequence: Synthetic oligonucleotide
  Target: FXN; (-) strand; PAM type: YTN; PAM sequence: CTG
gggctaatgtttcatccaac

SEQ ID NO: 25696 - DNA, 20 bp, Artificial Sequence
  Description of Artificial Sequence: Synthetic oligonucleotide
  Target: FXN; (-) strand; PAM type: YTN; PAM sequence: CTA
ggatctggggctaatgtttc

SEQ ID NO: 25697 - DNA, 20 bp, Artificial Sequence
  Description of Artificial Sequence: Synthetic oligonucleotide
  Target: FXN; (-) strand; PAM type: YTN; PAM sequence: TTC
taggatctggggctaatgtt

SEQ ID NO: 25698 - DNA, 20 bp, Artificial Sequence
  Description of Artificial Sequence: Synthetic oligonucleotide
  Target: FXN; (-) strand; PAM type: YTN; PAM sequence: CTT
ctaggatctggggctaatgt

SEQ ID NO: 25699 - DNA, 20 bp, Artificial Sequence
  Description of Artificial Sequence: Synthetic oligonucleotide
  Target: FXN; (-) strand; PAM type: YTN; PAM sequence: CTG
gcttctaggatctggggcta

SEQ ID NO: 25700 - DNA, 20 bp, Artificial Sequence
  Description of Artificial Sequence: Synthetic oligonucleotide
  Target: FXN; (-) strand; PAM type: YTN; PAM sequence: TTC
cctggcttctaggatctggg

SEQ ID NO: 25701 - DNA, 20 bp, Artificial Sequence
  Description of Artificial Sequence: Synthetic oligonucleotide
  Target: FXN; (-) strand; PAM type: YTN; PAM sequence: CTT
ccctggcttctaggatctgg

SEQ ID NO: 25702 - DNA, 20 bp, Artificial Sequence
  Description of Artificial Sequence: Synthetic oligonucleotide
  Target: FXN; (-) strand; PAM type: YTN; PAM sequence: CTG
gtggccagtcgataaagacc

SEQ ID NO: 25703 - DNA, 20 bp, Artificial Sequence
  Description of Artificial Sequence: Synthetic oligonucleotide
  Target: FXN; (-) strand; PAM type: YTN; PAM sequence: CTG
ccacctggtggccagtcgat

SEQ ID NO: 25704 - DNA, 20 bp, Artificial Sequence
  Description of Artificial Sequence: Synthetic oligonucleotide
  Target: FXN; (-) strand; PAM type: YTN; PAM sequence: TTG
cccaaatctgccacctggtg

SEQ ID NO: 25705 - DNA, 20 bp, Artificial Sequence
  Description of Artificial Sequence: Synthetic oligonucleotide
  Target: FXN; (-) strand; PAM type: YTN; PAM sequence: CTT
gcccaaatctgccacctggt

SEQ ID NO: 25706 - DNA, 20 bp, Artificial Sequence
  Description of Artificial Sequence: Synthetic oligonucleotide
  Target: FXN; (-) strand; PAM type: YTN; PAM sequence: CTA
aacccaaaggcagacccttg

SEQ ID NO: 25707 - DNA, 20 bp, Artificial Sequence
  Description of Artificial Sequence: Synthetic oligonucleotide
  Target: FXN; (-) strand; PAM type: YTN; PAM sequence: TTC
taaacccaaaggcagaccct

SEQ ID NO: 25708 - DNA, 20 bp, Artificial Sequence
  Description of Artificial Sequence: Synthetic oligonucleotide
  Target: FXN; (-) strand; PAM type: YTN; PAM sequence: CTA
agcaataattctaaacccaa

SEQ ID NO: 25709 - DNA, 20 bp, Artificial Sequence
  Description of Artificial Sequence: Synthetic oligonucleotide
  Target: FXN; (-) strand; PAM type: YTN; PAM sequence: TTA
aggcctaagcaataattcta

SEQ ID NO: 25710 - DNA, 20 bp, Artificial Sequence
  Description of Artificial Sequence: Synthetic oligonucleotide
  Target: FXN; (-) strand; PAM type: YTN; PAM sequence: TTT
aaggcctaagcaataattct

SEQ ID NO: 25711 - DNA, 20 bp, Artificial Sequence
  Description of Artificial Sequence: Synthetic oligonucleotide
  Target: FXN; (-) strand; PAM type: YTN; PAM sequence: CTT
taaggcctaagcaataattc

SEQ ID NO: 25712 - DNA, 20 bp, Artificial Sequence
  Description of Artificial Sequence: Synthetic oligonucleotide
  Target: FXN; (-) strand; PAM type: YTN; PAM sequence: CTA
ctttaaggcctaagcaataa

SEQ ID NO: 25713 - DNA, 20 bp, Artificial Sequence
  Description of Artificial Sequence: Synthetic oligonucleotide
  Target: FXN; (-) strand; PAM type: YTN; PAM sequence: CTG
gcaaaaaagaactactttaa

SEQ ID NO: 25714 - DNA, 20 bp, Artificial Sequence
  Description of Artificial Sequence: Synthetic oligonucleotide
  Target: FXN; (-) strand; PAM type: YTN; PAM sequence: CTC
ccactggcaaaaaagaacta

SEQ ID NO: 25715 - DNA, 20 bp, Artificial Sequence
  Description of Artificial Sequence: Synthetic oligonucleotide
  Target: FXN; (-) strand; PAM type: YTN; PAM sequence: TTC
tcccactggcaaaaaagaac

SEQ ID NO: 25716 - DNA, 20 bp, Artificial Sequence
  Description of Artificial Sequence: Synthetic oligonucleotide
  Target: FXN; (-) strand; PAM type: YTN; PAM sequence: TTT
ctcccactggcaaaaaagaa

SEQ ID NO: 25717 - DNA, 20 bp, Artificial Sequence
  Description of Artificial Sequence: Synthetic oligonucleotide
  Target: FXN; (-) strand; PAM type: YTN; PAM sequence: TTT
tctcccactggcaaaaaaga

SEQ ID NO: 25718 - DNA, 20 bp, Artificial Sequence
  Description of Artificial Sequence: Synthetic oligonucleotide
  Target: FXN; (-) strand; PAM type: YTN; PAM sequence: TTG
agggattttctcccactggc

SEQ ID NO: 25719 - DNA, 20 bp, Artificial Sequence
  Description of Artificial Sequence: Synthetic oligonucleotide
  Target: FXN; (-) strand; PAM type: YTN; PAM sequence: TTT
gagggattttctcccactgg

SEQ ID NO: 25720 - DNA, 20 bp, Artificial Sequence
  Description of Artificial Sequence: Synthetic oligonucleotide
  Target: FXN; (-) strand; PAM type: YTN; PAM sequence: CTT
tgagggattttctcccactg

SEQ ID NO: 25721 - DNA, 20 bp, Artificial Sequence
  Description of Artificial Sequence: Synthetic oligonucleotide
  Target: FXN; (-) strand; PAM type: YTN; PAM sequence: CTC
aaaaaacaaacaaacagaca

SEQ ID NO: 25722 - DNA, 20 bp, Artificial Sequence
  Description of Artificial Sequence: Synthetic oligonucleotide
  Target: FXN; (-) strand; PAM type: YTN; PAM sequence: CTG
tctcaaaaaacaaacaaaca

SEQ ID NO: 25723 - DNA, 20 bp, Artificial Sequence
  Description of Artificial Sequence: Synthetic oligonucleotide
  Target: FXN; (-) strand; PAM type: YTN; PAM sequence: CTC
tgtctcaaaaaacaaacaaa

SEQ ID NO: 25724 - DNA, 20 bp, Artificial Sequence
  Description of Artificial Sequence: Synthetic oligonucleotide
  Target: FXN; (-) strand; PAM type: YTN; PAM sequence: CTG
aataacagagggagactctg

SEQ ID NO: 25725 - DNA, 20 bp, Artificial Sequence
  Description of Artificial Sequence: Synthetic oligonucleotide
  Target: FXN; (-) strand; PAM type: YTN; PAM sequence: CTC
caggctgaataacagaggga

SEQ ID NO: 25726 - DNA, 20 bp, Artificial Sequence
  Description of Artificial Sequence: Synthetic oligonucleotide
  Target: FXN; (-) strand; PAM type: YTN; PAM sequence: CTG
cactccaggctgaataacag

SEQ ID NO: 25727 - DNA, 20 bp, Artificial Sequence
  Description of Artificial Sequence: Synthetic oligonucleotide
  Target: FXN; (-) strand; PAM type: YTN; PAM sequence: TTG
cagtgagatcatgccactgc

SEQ ID NO: 25728 - DNA, 20 bp, Artificial Sequence
  Description of Artificial Sequence: Synthetic oligonucleotide
  Target: FXN; (-) strand; PAM type: YTN; PAM sequence: TTG
aacccgagaggcagaggttg

SEQ ID NO: 25729 - DNA, 20 bp, Artificial Sequence
  Description of Artificial Sequence: Synthetic oligonucleotide
  Target: FXN; (-) strand; PAM type: YTN; PAM sequence: CTT
gaacccgagaggcagaggtt

SEQ ID NO: 25730 - DNA, 20 bp, Artificial Sequence
  Description of Artificial Sequence: Synthetic oligonucleotide
  Target: FXN; (-) strand; PAM type: YTN; PAM sequence: CTG
cttgaacccgagaggcagag

SEQ ID NO: 25731 - DNA, 20 bp, Artificial Sequence
  Description of Artificial Sequence: Synthetic oligonucleotide
  Target: FXN; (-) strand; PAM type: YTN; PAM sequence: TTG
aggcaggagaactgcttgaa

SEQ ID NO: 25732 - DNA, 20 bp, Artificial Sequence
  Description of Artificial Sequence: Synthetic oligonucleotide
  Target: FXN; (-) strand; PAM type: YTN; PAM sequence: TTG
ggaggttgaggcaggagaac

SEQ ID NO: 25733 - DNA, 20 bp, Artificial Sequence
  Description of Artificial Sequence: Synthetic oligonucleotide
  Target: FXN; (-) strand; PAM type: YTN; PAM sequence: CTT
gggaggttgaggcaggagaa

SEQ ID NO: 25734 - DNA, 20 bp, Artificial Sequence
  Description of Artificial Sequence: Synthetic oligonucleotide
  Target: FXN; (-) strand; PAM type: YTN; PAM sequence: CTA
cttgggaggttgaggcagga

SEQ ID NO: 25735 - DNA, 20 bp, Artificial Sequence
  Description of Artificial Sequence: Synthetic oligonucleotide
  Target: FXN; (-) strand; PAM type: YTN; PAM sequence: TTC
cagctacttgggaggttgag

SEQ ID NO: 25736 - DNA, 20 bp, Artificial Sequence
  Description of Artificial Sequence: Synthetic oligonucleotide
  Target: FXN; (-) strand; PAM type: YTN; PAM sequence: CTA
taattccagctacttgggag

SEQ ID NO: 25737 - DNA, 20 bp, Artificial Sequence
  Description of Artificial Sequence: Synthetic oligonucleotide
  Target: FXN; (-) strand; PAM type: YTN; PAM sequence: CTG
ggtgtgggggcgtgtgccta

SEQ ID NO: 25738 - DNA, 20 bp, Artificial Sequence
  Description of Artificial Sequence: Synthetic oligonucleotide
  Target: FXN; (-) strand; PAM type: YTN; PAM sequence: TTA
gctgggtgtgggggcgtgtg

SEQ ID NO: 25739 - DNA, 20 bp, Artificial Sequence
  Description of Artificial Sequence: Synthetic oligonucleotide
  Target: FXN; (-) strand; PAM type: YTN; PAM sequence: CTA
aaaatacaaaaattagctgg

SEQ ID NO: 25740 - DNA, 20 bp, Artificial Sequence
  Description of Artificial Sequence: Synthetic oligonucleotide
  Target: FXN; (-) strand; PAM type: YTN; PAM sequence: CTA
ctaaaaatacaaaaattagc

SEQ ID NO: 25741 - DNA, 20 bp, Artificial Sequence
  Description of Artificial Sequence: Synthetic oligonucleotide
  Target: FXN; (-) strand; PAM type: YTN; PAM sequence: CTC
tactaaaaatacaaaaatta

SEQ ID NO: 25742 - DNA, 20 bp, Artificial Sequence
  Description of Artificial Sequence: Synthetic oligonucleotide
  Target: FXN; (-) strand; PAM type: YTN; PAM sequence: CTG
tctctactaaaaatacaaaa

SEQ ID NO: 25743 - DNA, 20 bp, Artificial Sequence
  Description of Artificial Sequence: Synthetic oligonucleotide
  Target: FXN; (-) strand; PAM type: YTN; PAM sequence: CTG
gccaacgtggtgaaacactg

SEQ ID NO: 25744 - DNA, 20 bp, Artificial Sequence
  Description of Artificial Sequence: Synthetic oligonucleotide
  Target: FXN; (-) strand; PAM type: YTN; PAM sequence: TTC
aaaaccagcctggccaacgt

SEQ ID NO: 25745 - DNA, 20 bp, Artificial Sequence
  Description of Artificial Sequence: Synthetic oligonucleotide
  Target: FXN; (-) strand; PAM type: YTN; PAM sequence: TTC
aggagttcaaaaccagcctg

SEQ ID NO: 25746 - DNA, 20 bp, Artificial Sequence
  Description of Artificial Sequence: Synthetic oligonucleotide
  Target: FXN; (-) strand; PAM type: YTN; PAM sequence: TTG
agttcaggagttcaaaacca

SEQ ID NO: 25747 - DNA, 20 bp, Artificial Sequence
  Description of Artificial Sequence: Synthetic oligonucleotide
  Target: FXN; (-) strand; PAM type: YTN; PAM sequence: CTT
gagttcaggagttcaaaacc

SEQ ID NO: 25748 - DNA, 20 bp, Artificial Sequence
  Description of Artificial Sequence: Synthetic oligonucleotide
  Target: FXN; (-) strand; PAM type: YTN; PAM sequence: TTA
cttgagttcaggagttcaaa

SEQ ID NO: 25749 - DNA, 20 bp, Artificial Sequence
  Description of Artificial Sequence: Synthetic oligonucleotide
  Target: FXN; (-) strand; PAM type: YTN; PAM sequence: CTG
aggtgggaggattacttgag

SEQ ID NO: 25750 - DNA, 20 bp, Artificial Sequence
  Description of Artificial Sequence: Synthetic oligonucleotide
  Target: FXN; (-) strand; PAM type: YTN; PAM sequence: TTG
ggaggctgaggtgggaggat

SEQ ID NO: 25751 - DNA, 20 bp, Artificial Sequence
  Description of Artificial Sequence: Synthetic oligonucleotide
  Target: FXN; (-) strand; PAM type: YTN; PAM sequence: TTT
gggaggctgaggtgggagga

SEQ ID NO: 25752 - DNA, 20 bp, Artificial Sequence
  Description of Artificial Sequence: Synthetic oligonucleotide
  Target: FXN; (-) strand; PAM type: YTN; PAM sequence: CTT
tgggaggctgaggtgggagg

SEQ ID NO: 25753 - DNA, 20 bp, Artificial Sequence
  Description of Artificial Sequence: Synthetic oligonucleotide
  Target: FXN; (-) strand; PAM type: YTN; PAM sequence: CTA
gcactttgggaggctgaggt

SEQ ID NO: 25754 - DNA, 20 bp, Artificial Sequence
  Description of Artificial Sequence: Synthetic oligonucleotide
  Target: FXN; (-) strand; PAM type: YTN; PAM sequence: CTG
taatcctagcactttgggag

SEQ ID NO: 25755 - DNA, 20 bp, Artificial Sequence
  Description of Artificial Sequence: Synthetic oligonucleotide
  Target: FXN; (-) strand; PAM type: YTN; PAM sequence: CTC
acacctgtaatcctagcact

SEQ ID NO: 25756 - DNA, 20 bp, Artificial Sequence
  Description of Artificial Sequence: Synthetic oligonucleotide
  Target: FXN; (-) strand; PAM type: YTN; PAM sequence: TTG
aggagccaggcgcggtggct

SEQ ID NO: 25757 - DNA, 20 bp, Artificial Sequence
  Description of Artificial Sequence: Synthetic oligonucleotide
  Target: FXN; (-) strand; PAM type: YTN; PAM sequence: TTT
gaggagccaggcgcggtggc

SEQ ID NO: 25758 - DNA, 20 bp, Artificial Sequence
  Description of Artificial Sequence: Synthetic oligonucleotide
  Target: FXN; (-) strand; PAM type: YTN; PAM sequence: CTT
tgaggagccaggcgcggtgg

SEQ ID NO: 25759 - DNA, 20 bp, Artificial Sequence
  Description of Artificial Sequence: Synthetic oligonucleotide
  Target: FXN; (-) strand; PAM type: YTN; PAM sequence: TTA
acatctttgaggagccaggc

SEQ ID NO: 25760 - DNA, 20 bp, Artificial Sequence
  Description of Artificial Sequence: Synthetic oligonucleotide
  Target: FXN; (-) strand; PAM type: YTN; PAM sequence: TTG
ccatcaagaggattaacatc

SEQ ID NO: 25761 - DNA, 20 bp, Artificial Sequence
  Description of Artificial Sequence: Synthetic oligonucleotide
  Target: FXN; (-) strand; PAM type: YTN; PAM sequence: TTA
gtcaattgccatcaagagga

SEQ ID NO: 25762 - DNA, 20 bp, Artificial Sequence
  Description of Artificial Sequence: Synthetic oligonucleotide
  Target: FXN; (-) strand; PAM type: YTN; PAM sequence: CTG
gtattagtcaattgccatca

SEQ ID NO: 25763 - DNA, 20 bp, Artificial Sequence
  Description of Artificial Sequence: Synthetic oligonucleotide
  Target: FXN; (-) strand; PAM type: YTN; PAM sequence: TTC
tggtattagtcaattgccat

SEQ ID NO: 25764 - DNA, 20 bp, Artificial Sequence
  Description of Artificial Sequence: Synthetic oligonucleotide
  Target: FXN; (-) strand; PAM type: YTN; PAM sequence: TTT
ctggtattagtcaattgcca

SEQ ID NO: 25765 - DNA, 20 bp, Artificial Sequence
  Description of Artificial Sequence: Synthetic oligonucleotide
  Target: FXN; (-) strand; PAM type: YTN; PAM sequence: TTT
tctggtattagtcaattgcc

SEQ ID NO: 25766 - DNA, 20 bp, Artificial Sequence
  Description of Artificial Sequence: Synthetic oligonucleotide
  Target: FXN; (-) strand; PAM type: YTN; PAM sequence: TTC
gtgacattttctggtattag

SEQ ID NO: 25767 - DNA, 20 bp, Artificial Sequence
  Description of Artificial Sequence: Synthetic oligonucleotide
  Target: FXN; (-) strand; PAM type: YTN; PAM sequence: CTT
cgtgacattttctggtatta

SEQ ID NO: 25768 - DNA, 20 bp, Artificial Sequence
  Description of Artificial Sequence: Synthetic oligonucleotide
  Target: FXN; (-) strand; PAM type: YTN; PAM sequence: TTG
aatccaaaatgcacgcttcg

SEQ ID NO: 25769 - DNA, 20 bp, Artificial Sequence
  Description of Artificial Sequence: Synthetic oligonucleotide
  Target: FXN; (-) strand; PAM type: YTN; PAM sequence: TTC
catgattgaatccaaaatgc

SEQ ID NO: 25770 - DNA, 20 bp, Artificial Sequence
  Description of Artificial Sequence: Synthetic oligonucleotide
  Target: FXN; (-) strand; PAM type: YTN; PAM sequence: CTC
aacaattccatgattgaatc

SEQ ID NO: 25771 - DNA, 20 bp, Artificial Sequence
  Description of Artificial Sequence: Synthetic oligonucleotide
  Target: FXN; (-) strand; PAM type: YTN; PAM sequence: TTG
tcctcaacaattccatgatt

SEQ ID NO: 25772 - DNA, 20 bp, Artificial Sequence
  Description of Artificial Sequence: Synthetic oligonucleotide
  Target: FXN; (-) strand; PAM type: YTN; PAM sequence: CTG
attgtcctcaacaattccat

SEQ ID NO: 25773 - DNA, 20 bp, Artificial Sequence
  Description of Artificial Sequence: Synthetic oligonucleotide
  Target: FXN; (-) strand; PAM type: YTN; PAM sequence: CTG
atggctgattgtcctcaaca

SEQ ID NO: 25774 - DNA, 20 bp, Artificial Sequence
  Description of Artificial Sequence: Synthetic oligonucleotide
  Target: FXN; (-) strand; PAM type: YTN; PAM sequence: TTA
gtctgatggctgattgtcct

SEQ ID NO: 25775 - DNA, 20 bp, Artificial Sequence
  Description of Artificial Sequence: Synthetic oligonucleotide
  Target: FXN; (-) strand; PAM type: YTN; PAM sequence: TTT
agtctgatggctgattgtcc

SEQ ID NO: 25776 - DNA, 20 bp, Artificial Sequence
  Description of Artificial Sequence: Synthetic oligonucleotide
  Target: FXN; (-) strand; PAM type: YTN; PAM sequence: CTT
tagtctgatggctgattgtc

SEQ ID NO: 25777 - DNA, 20 bp, Artificial Sequence
  Description of Artificial Sequence: Synthetic oligonucleotide
  Target: FXN; (-) strand; PAM type: YTN; PAM sequence: CTA
tcgctttagtctgatggctg

SEQ ID NO: 25778 - DNA, 20 bp, Artificial Sequence
  Description of Artificial Sequence: Synthetic oligonucleotide
  Target: FXN; (-) strand; PAM type: YTN; PAM sequence: TTC
tatcgctttagtctgatggc

SEQ ID NO: 25779 - DNA, 20 bp, Artificial Sequence
  Description of Artificial Sequence: Synthetic oligonucleotide
  Target: FXN; (-) strand; PAM type: YTN; PAM sequence: TTT
ctatcgctttagtctgatgg

SEQ ID NO: 25780 - DNA, 20 bp, Artificial Sequence
  Description of Artificial Sequence: Synthetic oligonucleotide
  Target: FXN; (-) strand; PAM type: YTN; PAM sequence: CTA
tttctatcgctttagtctga

SEQ ID NO: 25781 - DNA, 20 bp, Artificial Sequence
  Description of Artificial Sequence: Synthetic oligonucleotide
  Target: FXN; (-) strand; PAM type: YTN; PAM sequence: TTC
caatactatttctatcgctt

SEQ ID NO: 25782 - DNA, 20 bp, Artificial Sequence
  Description of Artificial Sequence: Synthetic oligonucleotide
  Target: FXN; (-) strand; PAM type: YTN; PAM sequence: TTT
ccaatactatttctatcgct

SEQ ID NO: 25783 - DNA, 20 bp, Artificial Sequence
  Description of Artificial Sequence: Synthetic oligonucleotide
  Target: FXN; (-) strand; PAM type: YTN; PAM sequence: CTG
caatttccaatactatttct

SEQ ID NO: 25784 - DNA, 20 bp, Artificial Sequence
  Description of Artificial Sequence: Synthetic oligonucleotide
  Target: FXN; (-) strand; PAM type: YTN; PAM sequence: CTC
ccgctgcaatttccaatact

SEQ ID NO: 25785 - DNA, 20 bp, Artificial Sequence
  Description of Artificial Sequence: Synthetic oligonucleotide
  Target: FXN; (-) strand; PAM type: YTN; PAM sequence: TTC
agtgctcccgctgcaatttc

SEQ ID NO: 25786 - DNA, 20 bp, Artificial Sequence
  Description of Artificial Sequence: Synthetic oligonucleotide
  Target: FXN; (-) strand; PAM type: YTN; PAM sequence: CTC
cattcagtgctcccgctgca

SEQ ID NO: 25787 - DNA, 20 bp, Artificial Sequence
  Description of Artificial Sequence: Synthetic oligonucleotide
  Target: FXN; (-) strand; PAM type: YTN; PAM sequence: TTC
tccattcagtgctcccgctg

SEQ ID NO: 25788 - DNA, 20 bp, Artificial Sequence
  Description of Artificial Sequence: Synthetic oligonucleotide
  Target: FXN; (-) strand; PAM type: YTN; PAM sequence: CTT
ctccattcagtgctcccgct

SEQ ID NO: 25789 - DNA, 20 bp, Artificial Sequence
  Description of Artificial Sequence: Synthetic oligonucleotide
  Target: FXN; (-) strand; PAM type: YTN; PAM sequence: TTA
tgtggagtgccttctccatt

SEQ ID NO: 25790 - DNA, 20 bp, Artificial Sequence
  Description of Artificial Sequence: Synthetic oligonucleotide
  Target: FXN; (-) strand; PAM type: YTN; PAM sequence: CTC
cattatgtggagtgccttct

SEQ ID NO: 25791 - DNA, 20 bp, Artificial Sequence
  Description of Artificial Sequence: Synthetic oligonucleotide
  Target: FXN; (-) strand; PAM type: YTN; PAM sequence: CTC
ctccattatgtggagtgcct

SEQ ID NO: 25792 - DNA, 20 bp, Artificial Sequence
  Description of Artificial Sequence: Synthetic oligonucleotide
  Target: FXN; (-) strand; PAM type: YTN; PAM sequence: TTG
cctcctccattatgtggagt

SEQ ID NO: 25793 - DNA, 20 bp, Artificial Sequence
  Description of Artificial Sequence: Synthetic oligonucleotide
  Target: FXN; (-) strand; PAM type: YTN; PAM sequence: TTG
gttgcctcctccattatgtg

SEQ ID NO: 25794 - DNA, 20 bp, Artificial Sequence
  Description of Artificial Sequence: Synthetic oligonucleotide
  Target: FXN; (-) strand; PAM type: YTN; PAM sequence: CTT
ggttgcctcctccattatgt

SEQ ID NO: 25795 - DNA, 20 bp, Artificial Sequence
  Description of Artificial Sequence: Synthetic oligonucleotide
  Target: FXN; (-) strand; PAM type: YTN; PAM sequence: CTA
agacttggttgcctcctcca

SEQ ID NO: 25796 - DNA, 20 bp, Artificial Sequence
  Description of Artificial Sequence: Synthetic oligonucleotide
  Target: FXN; (-) strand; PAM type: YTN; PAM sequence: CTC
taagacttggttgcctcctc

SEQ ID NO: 25797 - DNA, 20 bp, Artificial Sequence
  Description of Artificial Sequence: Synthetic oligonucleotide
  Target: FXN; (-) strand; PAM type: YTN; PAM sequence: TTC
tctaagacttggttgcctcc

SEQ ID NO: 25798 - DNA, 20 bp, Artificial Sequence
  Description of Artificial Sequence: Synthetic oligonucleotide
  Target: FXN; (-) strand; PAM type: YTN; PAM sequence: CTT
ctctaagacttggttgcctc

SEQ ID NO: 25799 - DNA, 20 bp, Artificial Sequence
  Description of Artificial Sequence: Synthetic oligonucleotide
  Target: FXN; (-) strand; PAM type: YTN; PAM sequence: TTG
ataccttctctaagacttgg

SEQ ID NO: 25800 - DNA, 20 bp, Artificial Sequence
  Description of Artificial Sequence: Synthetic oligonucleotide
  Target: FXN; (-) strand; PAM type: YTN; PAM sequence: CTT
gataccttctctaagacttg

SEQ ID NO: 25801 - DNA, 20 bp, Artificial Sequence
  Description of Artificial Sequence: Synthetic oligonucleotide
  Target: FXN; (-) strand; PAM type: YTN; PAM sequence: TTA
tagtcaggcttgataccttc

SEQ ID NO: 25802 - DNA, 20 bp, Artificial Sequence
  Description of Artificial Sequence: Synthetic oligonucleotide
  Target: FXN; (-) strand; PAM type: YTN; PAM sequence: CTT
atagtcaggcttgatacctt

SEQ ID NO: 25803 - DNA, 20 bp, Artificial Sequence
  Description of Artificial Sequence: Synthetic oligonucleotide
  Target: FXN; (-) strand; PAM type: YTN; PAM sequence: CTG
tccttatagtcaggcttgat

SEQ ID NO: 25804 - DNA, 20 bp, Artificial Sequence
  Description of Artificial Sequence: Synthetic oligonucleotide
  Target: FXN; (-) strand; PAM type: YTN; PAM sequence: CTC
actgtccttatagtcaggct

SEQ ID NO: 25805 - DNA, 20 bp, Artificial Sequence
  Description of Artificial Sequence: Synthetic oligonucleotide
  Target: FXN; (-) strand; PAM type: YTN; PAM sequence: TTC
cctcactgtccttatagtca

SEQ ID NO: 25806 - DNA, 20 bp, Artificial Sequence
  Description of Artificial Sequence: Synthetic oligonucleotide
  Target: FXN; (-) strand; PAM type: YTN; PAM sequence: TTC
aattccctcactgtccttat

SEQ ID NO: 25807 - DNA, 20 bp, Artificial Sequence
  Description of Artificial Sequence: Synthetic oligonucleotide
  Target: FXN; (-) strand; PAM type: YTN; PAM sequence: TTT
caattccctcactgtcctta

SEQ ID NO: 25808 - DNA, 20 bp, Artificial Sequence
  Description of Artificial Sequence: Synthetic oligonucleotide
  Target: FXN; (-) strand; PAM type: YTN; PAM sequence: TTT
tcaattccctcactgtcctt

SEQ ID NO: 25809 - DNA, 20 bp, Artificial Sequence
  Description of Artificial Sequence: Synthetic oligonucleotide
  Target: FXN; (-) strand; PAM type: YTN; PAM sequence: TTT
ttcaattccctcactgtcct

SEQ ID NO: 25810 - DNA, 20 bp, Artificial Sequence
  Description of Artificial Sequence: Synthetic oligonucleotide
  Target: FXN; (-) strand; PAM type: YTN; PAM sequence: TTT
tttcaattccctcactgtcc

SEQ ID NO: 25811 - DNA, 20 bp, Artificial Sequence
  Description of Artificial Sequence: Synthetic oligonucleotide
  Target: FXN; (-) strand; PAM type: YTN; PAM sequence: TTG
ttttttcaattccctcactg

SEQ ID NO: 25812 - DNA, 20 bp, Artificial Sequence
  Description of Artificial Sequence: Synthetic oligonucleotide
  Target: FXN; (-) strand; PAM type: YTN; PAM sequence: TTT
gttttttcaattccctcact

SEQ ID NO: 25813 - DNA, 20 bp, Artificial Sequence
  Description of Artificial Sequence: Synthetic oligonucleotide
  Target: FXN; (-) strand; PAM type: YTN; PAM sequence: TTT
tgttttttcaattccctcac

SEQ ID NO: 25814 - DNA, 20 bp, Artificial Sequence
  Description of Artificial Sequence: Synthetic oligonucleotide
  Target: FXN; (-) strand; PAM type: YTN; PAM sequence: TTT
ttgttttttcaattccctca

SEQ ID NO: 25815 - DNA, 20 bp, Artificial Sequence
  Description of Artificial Sequence: Synthetic oligonucleotide
  Target: FXN; (-) strand; PAM type: YTN; PAM sequence: TTT
tttgttttttcaattccctc

SEQ ID NO: 25816 - DNA, 20 bp, Artificial Sequence
  Description of Artificial Sequence: Synthetic oligonucleotide
  Target: FXN; (-) strand; PAM type: YTN; PAM sequence: CTT
ttttgttttttcaattccct

SEQ ID NO: 25817 - DNA, 20 bp, Artificial Sequence
  Description of Artificial Sequence: Synthetic oligonucleotide
  Target: FXN; (-) strand; PAM type: YTN; PAM sequence: CTC
cttttttgttttttcaattc

SEQ ID NO: 25818 - DNA, 20 bp, Artificial Sequence
  Description of Artificial Sequence: Synthetic oligonucleotide
  Target: FXN; (-) strand; PAM type: YTN; PAM sequence: TTG
ctccttttttgttttttcaa

SEQ ID NO: 25819 - DNA, 20 bp, Artificial Sequence
  Description of Artificial Sequence: Synthetic oligonucleotide
  Target: FXN; (-) strand; PAM type: YTN; PAM sequence: CTC
cattgctccttttttgtttt

SEQ ID NO: 25820 - DNA, 20 bp, Artificial Sequence
  Description of Artificial Sequence: Synthetic oligonucleotide
  Target: FXN; (-) strand; PAM type: YTN; PAM sequence: CTG
ctccattgctccttttttgt

SEQ ID NO: 25821 - DNA, 20 bp, Artificial Sequence
  Description of Artificial Sequence: Synthetic oligonucleotide
  Target: FXN; (-) strand; PAM type: YTN; PAM sequence: TTC
cctgctccattgctcctttt

SEQ ID NO: 25822 - DNA, 20 bp, Artificial Sequence
  Description of Artificial Sequence: Synthetic oligonucleotide
  Target: FXN; (-) strand; PAM type: YTN; PAM sequence: CTT
ccctgctccattgctccttt

SEQ ID NO: 25823 - DNA, 20 bp, Artificial Sequence
  Description of Artificial Sequence: Synthetic oligonucleotide
  Target: FXN; (-) strand; PAM type: YTN; PAM sequence: TTC
aatccttccctgctccattg

SEQ ID NO: 25824 - DNA, 20 bp, Artificial Sequence
  Description of Artificial Sequence: Synthetic oligonucleotide
  Target: FXN; (-) strand; PAM type: YTN; PAM sequence: TTG
aaaggcattcaatccttccc

SEQ ID NO: 25825 - DNA, 20 bp, Artificial Sequence
  Description of Artificial Sequence: Synthetic oligonucleotide
  Target: FXN; (-) strand; PAM type: YTN; PAM sequence: CTT
gaaaggcattcaatccttcc

SEQ ID NO: 25826 - DNA, 20 bp, Artificial Sequence
  Description of Artificial Sequence: Synthetic oligonucleotide
  Target: FXN; (-) strand; PAM type: YTN; PAM sequence: CTA
cttgaaaggcattcaatcct

SEQ ID NO: 25827 - DNA, 20 bp, Artificial Sequence
  Description of Artificial Sequence: Synthetic oligonucleotide
  Target: FXN; (-) strand; PAM type: YTN; PAM sequence: CTG
aatctacttgaaaggcattc

SEQ ID NO: 25828 - DNA, 20 bp, Artificial Sequence
  Description of Artificial Sequence: Synthetic oligonucleotide
  Target: FXN; (-) strand; PAM type: YTN; PAM sequence: TTA
ctgaatctacttgaaaggca

SEQ ID NO: 25829 - DNA, 20 bp, Artificial Sequence
  Description of Artificial Sequence: Synthetic oligonucleotide
  Target: FXN; (-) strand; PAM type: YTN; PAM sequence: CTA
acagcaattactgaatctac

SEQ ID NO: 25830 - DNA, 20 bp, Artificial Sequence
  Description of Artificial Sequence: Synthetic oligonucleotide
  Target: FXN; (-) strand; PAM type: YTN; PAM sequence: CTG
ctaacagcaattactgaatc

SEQ ID NO: 25831 - DNA, 20 bp, Artificial Sequence
  Description of Artificial Sequence: Synthetic oligonucleotide
  Target: FXN; (-) strand; PAM type: YTN; PAM sequence: TTG
ctgctaacagcaattactga

SEQ ID NO: 25832 - DNA, 20 bp, Artificial Sequence
  Description of Artificial Sequence: Synthetic oligonucleotide
  Target: FXN; (-) strand; PAM type: YTN; PAM sequence: TTT
gctgctaacagcaattactg

SEQ ID NO: 25833 - DNA, 20 bp, Artificial Sequence
  Description of Artificial Sequence: Synthetic oligonucleotide
  Target: FXN; (-) strand; PAM type: YTN; PAM sequence: TTT
tgctgctaacagcaattact

SEQ ID NO: 25834 - DNA, 20 bp, Artificial Sequence
  Description of Artificial Sequence: Synthetic oligonucleotide
  Target: FXN; (-) strand; PAM type: YTN; PAM sequence: TTT
ttgctgctaacagcaattac

SEQ ID NO: 25835 - DNA, 20 bp, Artificial Sequence
  Description of Artificial Sequence: Synthetic oligonucleotide
  Target: FXN; (-) strand; PAM type: YTN; PAM sequence: TTT
tttgctgctaacagcaatta

SEQ ID NO: 25836 - DNA, 20 bp, Artificial Sequence
  Description of Artificial Sequence: Synthetic oligonucleotide
  Target: FXN; (-) strand; PAM type: YTN; PAM sequence: CTG
cattttttgctgctaacagc

SEQ ID NO: 25837 - DNA, 20 bp, Artificial Sequence
  Description of Artificial Sequence: Synthetic oligonucleotide
  Target: FXN; (-) strand; PAM type: YTN; PAM sequence: CTA
ctgcattttttgctgctaac

SEQ ID NO: 25838 - DNA, 20 bp, Artificial Sequence
  Description of Artificial Sequence: Synthetic oligonucleotide
  Target: FXN; (-) strand; PAM type: YTN; PAM sequence: CTG
cccaggcactactgcatttt

SEQ ID NO: 25839 - DNA, 20 bp, Artificial Sequence
  Description of Artificial Sequence: Synthetic oligonucleotide
  Target: FXN; (-) strand; PAM type: YTN; PAM sequence: TTA
aagccctgcccaggcactac

SEQ ID NO: 25840 - DNA, 20 bp, Artificial Sequence
  Description of Artificial Sequence: Synthetic oligonucleotide
  Target: FXN; (-) strand; PAM type: YTN; PAM sequence: TTT
aaagccctgcccaggcacta

SEQ ID NO: 25841 - DNA, 20 bp, Artificial Sequence
  Description of Artificial Sequence: Synthetic oligonucleotide
  Target: FXN; (-) strand; PAM type: YTN; PAM sequence: CTT
taaagccctgcccaggcact

SEQ ID NO: 25842 - DNA, 20 bp, Artificial Sequence
  Description of Artificial Sequence: Synthetic oligonucleotide
  Target: FXN; (-) strand; PAM type: YTN; PAM sequence: CTG
tgcaagcactttaaagccct

SEQ ID NO: 25843 - DNA, 20 bp, Artificial Sequence
  Description of Artificial Sequence: Synthetic oligonucleotide
  Target: FXN; (-) strand; PAM type: YTN; PAM sequence: CTG
cctgtgcaagcactttaaag

SEQ ID NO: 25844 - DNA, 20 bp, Artificial Sequence
  Description of Artificial Sequence: Synthetic oligonucleotide
  Target: FXN; (-) strand; PAM type: YTN; PAM sequence: CTA
gggctgcctgtgcaagcact

SEQ ID NO: 25845 - DNA, 20 bp, Artificial Sequence
  Description of Artificial Sequence: Synthetic oligonucleotide
  Target: FXN; (-) strand; PAM type: YTN; PAM sequence: CTC
tagggctgcctgtgcaagca

SEQ ID NO: 25846 - DNA, 20 bp, Artificial Sequence
  Description of Artificial Sequence: Synthetic oligonucleotide
  Target: FXN; (-) strand; PAM type: YTN; PAM sequence: TTC
ccaagcagcccggccctcta

SEQ ID NO: 25847 - DNA, 20 bp, Artificial Sequence
  Description of Artificial Sequence: Synthetic oligonucleotide
  Target: FXN; (-) strand; PAM type: YTN; PAM sequence: TTG
taagagttcccaagcagccc

SEQ ID NO: 25848 - DNA, 20 bp, Artificial Sequence
  Description of Artificial Sequence: Synthetic oligonucleotide
  Target: FXN; (-) strand; PAM type: YTN; PAM sequence: TTT
gtaagagttcccaagcagcc

SEQ ID NO: 25849 - DNA, 20 bp, Artificial Sequence
  Description of Artificial Sequence: Synthetic oligonucleotide
  Target: FXN; (-) strand; PAM type: YTN; PAM sequence: TTG
gtaggtcagtttgtaagagt

SEQ ID NO: 25850 - DNA, 20 bp, Artificial Sequence
  Description of Artificial Sequence: Synthetic oligonucleotide
  Target: FXN; (-) strand; PAM type: YTN; PAM sequence: CTC
aagttggtaggtcagtttgt

SEQ ID NO: 25851 - DNA, 20 bp, Artificial Sequence
  Description of Artificial Sequence: Synthetic oligonucleotide
  Target: FXN; (-) strand; PAM type: YTN; PAM sequence: CTG
tggatgctcaagttggtagg

SEQ ID NO: 25852 - DNA, 20 bp, Artificial Sequence
  Description of Artificial Sequence: Synthetic oligonucleotide
  Target: FXN; (-) strand; PAM type: YTN; PAM sequence: CTG
atcaggctgtggatgctcaa

SEQ ID NO: 25853 - DNA, 20 bp, Artificial Sequence
  Description of Artificial Sequence: Synthetic oligonucleotide
  Target: FXN; (-) strand; PAM type: YTN; PAM sequence: CTC
tgatcaggctgtggatgctc

SEQ ID NO: 25854 - DNA, 20 bp, Artificial Sequence
  Description of Artificial Sequence: Synthetic oligonucleotide
  Target: FXN; (-) strand; PAM type: YTN; PAM sequence: CTC
ccccacctctgatcaggctg

SEQ ID NO: 25855 - DNA, 20 bp, Artificial Sequence
  Description of Artificial Sequence: Synthetic oligonucleotide
  Target: FXN; (-) strand; PAM type: YTN; PAM sequence: TTA
actcccccacctctgatcag

SEQ ID NO: 25856 - DNA, 20 bp, Artificial Sequence
  Description of Artificial Sequence: Synthetic oligonucleotide
  Target: FXN; (-) strand; PAM type: YTN; PAM sequence: CTT
aactcccccacctctgatca

SEQ ID NO: 25857 - DNA, 20 bp, Artificial Sequence
  Description of Artificial Sequence: Synthetic oligonucleotide
  Target: FXN; (-) strand; PAM type: YTN; PAM sequence: CTA
ggggagagaaggcccttaac

SEQ ID NO: 25858 - DNA, 20 bp, Artificial Sequence
  Description of Artificial Sequence: Synthetic oligonucleotide
  Target: FXN; (-) strand; PAM type: YTN; PAM sequence: CTA
gtagaggctaggggagagaa

SEQ ID NO: 25859 - DNA, 20 bp, Artificial Sequence
  Description of Artificial Sequence: Synthetic oligonucleotide
  Target: FXN; (-) strand; PAM type: YTN; PAM sequence: CTC
tagtagaggctaggggagag

SEQ ID NO: 25860 - DNA, 20 bp, Artificial Sequence
  Description of Artificial Sequence: Synthetic oligonucleotide
  Target: FXN; (-) strand; PAM type: YTN; PAM sequence: TTA
caggctctagtagaggctag

SEQ ID NO: 25861 - DNA, 20 bp, Artificial Sequence
  Description of Artificial Sequence: Synthetic oligonucleotide
  Target: FXN; (-) strand; PAM type: YTN; PAM sequence: CTG
cagttacaggctctagtaga

SEQ ID NO: 25862 - DNA, 20 bp, Artificial Sequence
  Description of Artificial Sequence: Synthetic oligonucleotide
  Target: FXN; (-) strand; PAM type: YTN; PAM sequence: TTC
cctgcagttacaggctctag

SEQ ID NO: 25863 - DNA, 20 bp, Artificial Sequence
  Description of Artificial Sequence: Synthetic oligonucleotide
  Target: FXN; (-) strand; PAM type: YTN; PAM sequence: TTT
ccctgcagttacaggctcta

SEQ ID NO: 25864 - DNA, 20 bp, Artificial Sequence
  Description of Artificial Sequence: Synthetic oligonucleotide
  Target: FXN; (-) strand; PAM type: YTN; PAM sequence: TTG
gtttccctgcagttacaggc

SEQ ID NO: 25865 - DNA, 20 bp, Artificial Sequence
  Description of Artificial Sequence: Synthetic oligonucleotide
  Target: FXN; (-) strand; PAM type: YTN; PAM sequence: CTT
ggtttccctgcagttacagg

SEQ ID NO: 25866 - DNA, 20 bp, Artificial Sequence
  Description of Artificial Sequence: Synthetic oligonucleotide
  Target: FXN; (-) strand; PAM type: YTN; PAM sequence: CTG
caacttggtttccctgcagt

SEQ ID NO: 25867 - DNA, 20 bp, Artificial Sequence
  Description of Artificial Sequence: Synthetic oligonucleotide
  Target: FXN; (-) strand; PAM type: YTN; PAM sequence: TTA
gcctgcaacttggtttccct

SEQ ID NO: 25868 - DNA, 20 bp, Artificial Sequence
  Description of Artificial Sequence: Synthetic oligonucleotide
  Target: FXN; (-) strand; PAM type: YTN; PAM sequence: TTT
agcctgcaacttggtttccc

SEQ ID NO: 25869 - DNA, 20 bp, Artificial Sequence
  Description of Artificial Sequence: Synthetic oligonucleotide
  Target: FXN; (-) strand; PAM type: YTN; PAM sequence: CTG
catgtgtgggcagagtttag

SEQ ID NO: 25870 - DNA, 20 bp, Artificial Sequence
  Description of Artificial Sequence: Synthetic oligonucleotide
  Target: FXN; (-) strand; PAM type: YTN; PAM sequence: CTA
atcaatgtctgcatgtgtgg

SEQ ID NO: 25871 - DNA, 20 bp, Artificial Sequence
  Description of Artificial Sequence: Synthetic oligonucleotide
  Target: FXN; (-) strand; PAM type: YTN; PAM sequence: TTG
ctaatcaatgtctgcatgtg

SEQ ID NO: 25872 - DNA, 20 bp, Artificial Sequence
  Description of Artificial Sequence: Synthetic oligonucleotide
  Target: FXN; (-) strand; PAM type: YTN; PAM sequence: CTT
gctaatcaatgtctgcatgt

SEQ ID NO: 25873 - DNA, 20 bp, Artificial Sequence
  Description of Artificial Sequence: Synthetic oligonucleotide
  Target: FXN; (-) strand; PAM type: YTN; PAM sequence: TTG
tagcttgctaatcaatgtct

SEQ ID NO: 25874 - DNA, 20 bp, Artificial Sequence
  Description of Artificial Sequence: Synthetic oligonucleotide
  Target: FXN; (-) strand; PAM type: YTN; PAM sequence: TTT
gtagcttgctaatcaatgtc

SEQ ID NO: 25875 - DNA, 20 bp, Artificial Sequence
  Description of Artificial Sequence: Synthetic oligonucleotide
  Target: FXN; (-) strand; PAM type: YTN; PAM sequence: TTT
tgtagcttgctaatcaatgt

SEQ ID NO: 25876 - DNA, 20 bp, Artificial Sequence
  Description of Artificial Sequence: Synthetic oligonucleotide
  Target: FXN; (-) strand; PAM type: YTN; PAM sequence: TTT
ttgtagcttgctaatcaatg

SEQ ID NO: 25877 - DNA, 20 bp, Artificial Sequence
  Description of Artificial Sequence: Synthetic oligonucleotide
  Target: FXN; (-) strand; PAM type: YTN; PAM sequence: CTG
tttttgtagcttgctaatca

SEQ ID NO: 25878 - DNA, 20 bp, Artificial Sequence
  Description of Artificial Sequence: Synthetic oligonucleotide
  Target: FXN; (-) strand; PAM type: YTN; PAM sequence: TTC
atgactgtttttgtagcttg

SEQ ID NO: 25879 - DNA, 20 bp, Artificial Sequence
  Description of Artificial Sequence: Synthetic oligonucleotide
  Target: FXN; (-) strand; PAM type: YTN; PAM sequence: TTT
catgactgtttttgtagctt

SEQ ID NO: 25880 - DNA, 20 bp, Artificial Sequence
  Description of Artificial Sequence: Synthetic oligonucleotide
  Target: FXN; (-) strand; PAM type: YTN; PAM sequence: CTA
taaaaacaggtttcatgact

SEQ ID NO: 25881 - DNA, 20 bp, Artificial Sequence
  Description of Artificial Sequence: Synthetic oligonucleotide
  Target: FXN; (-) strand; PAM type: YTN; PAM sequence: CTA
atcctataaaaacaggtttc

SEQ ID NO: 25882 - DNA, 20 bp, Artificial Sequence
  Description of Artificial Sequence: Synthetic oligonucleotide
  Target: FXN; (-) strand; PAM type: YTN; PAM sequence: TTC
actaatcctataaaaacagg

SEQ ID NO: 25883 - DNA, 20 bp, Artificial Sequence
  Description of Artificial Sequence: Synthetic oligonucleotide
  Target: FXN; (-) strand; PAM type: YTN; PAM sequence: CTT
cactaatcctataaaaacag

SEQ ID NO: 25884 - DNA, 20 bp, Artificial Sequence
  Description of Artificial Sequence: Synthetic oligonucleotide
  Target: FXN; (-) strand; PAM type: YTN; PAM sequence: CTG
gggcttcactaatcctataa

SEQ ID NO: 25885 - DNA, 20 bp, Artificial Sequence
  Description of Artificial Sequence: Synthetic oligonucleotide
  Target: FXN; (-) strand; PAM type: YTN; PAM sequence: CTG
gtcaaactggggcttcacta

SEQ ID NO: 25886 - DNA, 20 bp, Artificial Sequence
  Description of Artificial Sequence: Synthetic oligonucleotide
  Target: FXN; (-) strand; PAM type: YTN; PAM sequence: CTC
tggtcaaactggggcttcac

SEQ ID NO: 25887 - DNA, 20 bp, Artificial Sequence
  Description of Artificial Sequence: Synthetic oligonucleotide
  Target: FXN; (-) strand; PAM type: YTN; PAM sequence: TTC
atgcaaagtactctggtcaa

SEQ ID NO: 25888 - DNA, 20 bp, Artificial Sequence
  Description of Artificial Sequence: Synthetic oligonucleotide
  Target: FXN; (-) strand; PAM type: YTN; PAM sequence: CTA
acaaaacattcatgcaaagt

SEQ ID NO: 25889 - DNA, 20 bp, Artificial Sequence
  Description of Artificial Sequence: Synthetic oligonucleotide
  Target: FXN; (-) strand; PAM type: YTN; PAM sequence: TTC
taacaaaacattcatgcaaa

SEQ ID NO: 25890 - DNA, 20 bp, Artificial Sequence
  Description of Artificial Sequence: Synthetic oligonucleotide
  Target: FXN; (-) strand; PAM type: YTN; PAM sequence: CTT
ctaacaaaacattcatgcaa

SEQ ID NO: 25891 - DNA, 20 bp, Artificial Sequence
  Description of Artificial Sequence: Synthetic oligonucleotide
  Target: FXN; (-) strand; PAM type: YTN; PAM sequence: TTG
cttctaacaaaacattcatg

SEQ ID NO: 25892 - DNA, 20 bp, Artificial Sequence
  Description of Artificial Sequence: Synthetic oligonucleotide
  Target: FXN; (-) strand; PAM type: YTN; PAM sequence: TTT
gcttctaacaaaacattcat

SEQ ID NO: 25893 - DNA, 20 bp, Artificial Sequence
  Description of Artificial Sequence: Synthetic oligonucleotide
  Target: FXN; (-) strand; PAM type: YTN; PAM sequence: TTG
gcacatttgcttctaacaaa

SEQ ID NO: 25894 - DNA, 20 bp, Artificial Sequence
  Description of Artificial Sequence: Synthetic oligonucleotide
  Target: FXN; (-) strand; PAM type: YTN; PAM sequence: CTA
gaatattggcacatttgctt

SEQ ID NO: 25895 - DNA, 20 bp, Artificial Sequence
  Description of Artificial Sequence: Synthetic oligonucleotide
  Target: FXN; (-) strand; PAM type: YTN; PAM sequence: CTG
ctagaatattggcacatttg

SEQ ID NO: 25896 - DNA, 20 bp, Artificial Sequence
  Description of Artificial Sequence: Synthetic oligonucleotide
  Target: FXN; (-) strand; PAM type: YTN; PAM sequence: CTC
aaaaaaaaaaaaaaagaaga

SEQ ID NO: 25897 - DNA, 20 bp, Artificial Sequence
  Description of Artificial Sequence: Synthetic oligonucleotide
  Target: FXN; (-) strand; PAM type: YTN; PAM sequence: TTC
aactcaaaaaaaaaaaaaaa

SEQ ID NO: 25898 - DNA, 20 bp, Artificial Sequence
  Description of Artificial Sequence: Synthetic oligonucleotide
  Target: FXN; (-) strand; PAM type: YTN; PAM sequence: CTT
caactcaaaaaaaaaaaaaa

SEQ ID NO: 25899 - DNA, 20 bp, Artificial Sequence
  Description of Artificial Sequence: Synthetic oligonucleotide
  Target: FXN; (-) strand; PAM type: YTN; PAM sequence: CTA
ggcttcaactcaaaaaaaaa

SEQ ID NO: 25900 - DNA, 20 bp, Artificial Sequence
  Description of Artificial Sequence: Synthetic oligonucleotide
  Target: FXN; (-) strand; PAM type: YTN; PAM sequence: CTG
ggtgacagagctaggcttca

SEQ ID NO: 25901 - DNA, 20 bp, Artificial Sequence
  Description of Artificial Sequence: Synthetic oligonucleotide
  Target: FXN; (-) strand; PAM type: YTN; PAM sequence: CTC
cagcctgggtgacagagcta

SEQ ID NO: 25902 - DNA, 20 bp, Artificial Sequence
  Description of Artificial Sequence: Synthetic oligonucleotide
  Target: FXN; (-) strand; PAM type: YTN; PAM sequence: CTG
cactccagcctgggtgacag

SEQ ID NO: 25903 - DNA, 20 bp, Artificial Sequence
  Description of Artificial Sequence: Synthetic oligonucleotide
  Target: FXN; (-) strand; PAM type: YTN; PAM sequence: CTG
agatcacacaactgcactcc

SEQ ID NO: 25904 - DNA, 20 bp, Artificial Sequence
  Description of Artificial Sequence: Synthetic oligonucleotide
  Target: FXN; (-) strand; PAM type: YTN; PAM sequence: TTG
cagtgagctgagatcacaca

SEQ ID NO: 25905 - DNA, 20 bp, Artificial Sequence
  Description of Artificial Sequence: Synthetic oligonucleotide
  Target: FXN; (-) strand; PAM type: YTN; PAM sequence: CTG
ggaggcagaggttgcagtga

SEQ ID NO: 25906 - DNA, 20 bp, Artificial Sequence
  Description of Artificial Sequence: Synthetic oligonucleotide
  Target: FXN; (-) strand; PAM type: YTN; PAM sequence: TTG
aacctgggaggcagaggttg

SEQ ID NO: 25907 - DNA, 20 bp, Artificial Sequence
  Description of Artificial Sequence: Synthetic oligonucleotide
  Target: FXN; (-) strand; PAM type: YTN; PAM sequence: CTT
gaacctgggaggcagaggtt

SEQ ID NO: 25908 - DNA, 20 bp, Artificial Sequence
  Description of Artificial Sequence: Synthetic oligonucleotide
  Target: FXN; (-) strand; PAM type: YTN; PAM sequence: TTG
aggcgggagaatcgcttgaa

SEQ ID NO: 25909 - DNA, 20 bp, Artificial Sequence
  Description of Artificial Sequence: Synthetic oligonucleotide
  Target: FXN; (-) strand; PAM type: YTN; PAM sequence: CTC
aggaggttgaggcgggagaa

SEQ ID NO: 25910 - DNA, 20 bp, Artificial Sequence
  Description of Artificial Sequence: Synthetic oligonucleotide
  Target: FXN; (-) strand; PAM type: YTN; PAM sequence: CTA
ctcaggaggttgaggcggga

SEQ ID NO: 25911 - DNA, 20 bp, Artificial Sequence
  Description of Artificial Sequence: Synthetic oligonucleotide
  Target: FXN; (-) strand; PAM type: YTN; PAM sequence: CTG
taatcccagctactcaggag

SEQ ID NO: 25912 - DNA, 20 bp, Artificial Sequence
  Description of Artificial Sequence: Synthetic oligonucleotide
  Target: FXN; (-) strand; PAM type: YTN; PAM sequence: TTG
tggtacatgtctgtaatccc

SEQ ID NO: 25913 - DNA, 20 bp, Artificial Sequence
  Description of Artificial Sequence: Synthetic oligonucleotide
  Target: FXN; (-) strand; PAM type: YTN; PAM sequence: CTG
tattgtggtacatgtctgta

SEQ ID NO: 25914 - DNA, 20 bp, Artificial Sequence
  Description of Artificial Sequence: Synthetic oligonucleotide
  Target: FXN; (-) strand; PAM type: YTN; PAM sequence: TTA
gccctgtattgtggtacatg

SEQ ID NO: 25915 - DNA, 20 bp, Artificial Sequence
  Description of Artificial Sequence: Synthetic oligonucleotide
  Target: FXN; (-) strand; PAM type: YTN; PAM sequence: CTT
agccctgtattgtggtacat

SEQ ID NO: 25916 - DNA, 20 bp, Artificial Sequence
  Description of Artificial Sequence: Synthetic oligonucleotide
  Target: FXN; (-) strand; PAM type: YTN; PAM sequence: CTA
aaaatacaaaacttagccct

SEQ ID NO: 25917 - DNA, 20 bp, Artificial Sequence
  Description of Artificial Sequence: Synthetic oligonucleotide
  Target: FXN; (-) strand; PAM type: YTN; PAM sequence: CTA
ctaaaaatacaaaacttagc

SEQ ID NO: 25918 - DNA, 20 bp, Artificial Sequence
  Description of Artificial Sequence: Synthetic oligonucleotide
  Target: FXN; (-) strand; PAM type: YTN; PAM sequence: TTC
tactaaaaatacaaaactta

SEQ ID NO: 25919 - DNA, 20 bp, Artificial Sequence
  Description of Artificial Sequence: Synthetic oligonucleotide
  Target: FXN; (-) strand; PAM type: YTN; PAM sequence: TTT
ctactaaaaatacaaaactt

SEQ ID NO: 25920 - DNA, 20 bp, Artificial Sequence
  Description of Artificial Sequence: Synthetic oligonucleotide
  Target: FXN; (-) strand; PAM type: YTN; PAM sequence: CTG
gccaacatggtgaaacccca

SEQ ID NO: 25921 - DNA, 20 bp, Artificial Sequence
  Description of Artificial Sequence: Synthetic oligonucleotide
  Target: FXN; (-) strand; PAM type: YTN; PAM sequence: TTG
agaccagcctggccaacatg

SEQ ID NO: 25922 - DNA, 20 bp, Artificial Sequence
  Description of Artificial Sequence: Synthetic oligonucleotide
  Target: FXN; (-) strand; PAM type: YTN; PAM sequence: TTT
gagaccagcctggccaacat

SEQ ID NO: 25923 - DNA, 20 bp, Artificial Sequence
  Description of Artificial Sequence: Synthetic oligonucleotide
  Target: FXN; (-) strand; PAM type: YTN; PAM sequence: TTG
agatcaggagtttgagacca

SEQ ID NO: 25924 - DNA, 20 bp, Artificial Sequence
  Description of Artificial Sequence: Synthetic oligonucleotide
  Target: FXN; (-) strand; PAM type: YTN; PAM sequence: CTT
gagatcaggagtttgagacc

SEQ ID NO: 25925 - DNA, 20 bp, Artificial Sequence
  Description of Artificial Sequence: Synthetic oligonucleotide
  Target: FXN; (-) strand; PAM type: YTN; PAM sequence: CTG
aggcgggtggatcacttgag

SEQ ID NO: 25926 - DNA, 20 bp, Artificial Sequence
  Description of Artificial Sequence: Synthetic oligonucleotide
  Target: FXN; (-) strand; PAM type: YTN; PAM sequence: TTA
ggaggctgaggcgggtggat

SEQ ID NO: 25927 - DNA, 20 bp, Artificial Sequence
  Description of Artificial Sequence: Synthetic oligonucleotide
  Target: FXN; (-) strand; PAM type: YTN; PAM sequence: TTT
aggaggctgaggcgggtgga

SEQ ID NO: 25928 - DNA, 20 bp, Artificial Sequence
  Description of Artificial Sequence: Synthetic oligonucleotide
  Target: FXN; (-) strand; PAM type: YTN; PAM sequence: CTT
taggaggctgaggcgggtgg

SEQ ID NO: 25929 - DNA, 20 bp, Artificial Sequence
  Description of Artificial Sequence: Synthetic oligonucleotide
  Target: FXN; (-) strand; PAM type: YTN; PAM sequence: TTA
acccagcactttaggaggct

SEQ ID NO: 25930 - DNA, 20 bp, Artificial Sequence
  Description of Artificial Sequence: Synthetic oligonucleotide
  Target: FXN; (-) strand; PAM type: YTN; PAM sequence: CTG
ttaacccagcactttaggag

SEQ ID NO: 25931 - DNA, 20 bp, Artificial Sequence
  Description of Artificial Sequence: Synthetic oligonucleotide
  Target: FXN; (-) strand; PAM type: YTN; PAM sequence: CTC
atgcctgttaacccagcact

SEQ ID NO: 25932 - DNA, 20 bp, Artificial Sequence
  Description of Artificial Sequence: Synthetic oligonucleotide
  Target: FXN; (-) strand; PAM type: YTN; PAM sequence: TTG
ccaggtgccgtggctcatgc

SEQ ID NO: 25933 - DNA, 20 bp, Artificial Sequence
  Description of Artificial Sequence: Synthetic oligonucleotide
  Target: FXN; (-) strand; PAM type: YTN; PAM sequence: TTT
gccaggtgccgtggctcatg

SEQ ID NO: 25934 - DNA, 20 bp, Artificial Sequence
  Description of Artificial Sequence: Synthetic oligonucleotide
  Target: FXN; (-) strand; PAM type: YTN; PAM sequence: TTT
tgccaggtgccgtggctcat

SEQ ID NO: 25935 - DNA, 20 bp, Artificial Sequence
  Description of Artificial Sequence: Synthetic oligonucleotide
  Target: FXN; (-) strand; PAM type: YTN; PAM sequence: CTT
ttgccaggtgccgtggctca

SEQ ID NO: 25936 - DNA, 20 bp, Artificial Sequence
  Description of Artificial Sequence: Synthetic oligonucleotide
  Target: FXN; (-) strand; PAM type: YTN; PAM sequence: TTC
aatagaagtaaaccaaaaga

SEQ ID NO: 25937 - DNA, 20 bp, Artificial Sequence
  Description of Artificial Sequence: Synthetic oligonucleotide
  Target: FXN; (-) strand; PAM type: YTN; PAM sequence: TTC
agttcaatagaagtaaacca

SEQ ID NO: 25938 - DNA, 20 bp, Artificial Sequence
  Description of Artificial Sequence: Synthetic oligonucleotide
  Target: FXN; (-) strand; PAM type: YTN; PAM sequence: TTT
cagttcaatagaagtaaacc

SEQ ID NO: 25939 - DNA, 20 bp, Artificial Sequence
  Description of Artificial Sequence: Synthetic oligonucleotide
  Target: FXN; (-) strand; PAM type: YTN; PAM sequence: TTT
tcagttcaatagaagtaaac

SEQ ID NO: 25940 - DNA, 20 bp, Artificial Sequence
  Description of Artificial Sequence: Synthetic oligonucleotide
  Target: FXN; (-) strand; PAM type: YTN; PAM sequence: TTT
ttcagttcaatagaagtaaa

SEQ ID NO: 25941 - DNA, 20 bp, Artificial Sequence
  Description of Artificial Sequence: Synthetic oligonucleotide
  Target: FXN; (-) strand; PAM type: YTN; PAM sequence: CTT
tttcagttcaatagaagtaa

SEQ ID NO: 25942 - DNA, 20 bp, Artificial Sequence
  Description of Artificial Sequence: Synthetic oligonucleotide
  Target: FXN; (-) strand; PAM type: YTN; PAM sequence: TTG
tgactttttcagttcaatag

SEQ ID NO: 25943 - DNA, 20 bp, Artificial Sequence
  Description of Artificial Sequence: Synthetic oligonucleotide
  Target: FXN; (-) strand; PAM type: YTN; PAM sequence: TTT
gtgactttttcagttcaata

SEQ ID NO: 25944 - DNA, 20 bp, Artificial Sequence
  Description of Artificial Sequence: Synthetic oligonucleotide
  Target: FXN; (-) strand; PAM type: YTN; PAM sequence: TTA
aatataaatatatttgtgac

SEQ ID NO: 25945 - DNA, 20 bp, Artificial Sequence
  Description of Artificial Sequence: Synthetic oligonucleotide
  Target: FXN; (-) strand; PAM type: YTN; PAM sequence: TTA
attaaatataaatatatttg

SEQ ID NO: 25946 - DNA, 20 bp, Artificial Sequence
  Description of Artificial Sequence: Synthetic oligonucleotide
  Target: FXN; (-) strand; PAM type: YTN; PAM sequence: TTT
aattaaatataaatatattt

SEQ ID NO: 25947 - DNA, 20 bp, Artificial Sequence
  Description of Artificial Sequence: Synthetic oligonucleotide
  Target: FXN; (-) strand; PAM type: YTN; PAM sequence: TTA
tataaatatatttaattaaa

SEQ ID NO: 25948 - DNA, 20 bp, Artificial Sequence
  Description of Artificial Sequence: Synthetic oligonucleotide
  Target: FXN; (-) strand; PAM type: YTN; PAM sequence: TTT
atataaatatatttaattaa

SEQ ID NO: 25949 - DNA, 20 bp, Artificial Sequence
  Description of Artificial Sequence: Synthetic oligonucleotide
  Target: FXN; (-) strand; PAM type: YTN; PAM sequence: TTT
tatataaatatatttaatta

SEQ ID NO: 25950 - DNA, 20 bp, Artificial Sequence
  Description of Artificial Sequence: Synthetic oligonucleotide
  Target: FXN; (-) strand; PAM type: YTN; PAM sequence: TTT
ttatataaatatatttaatt

SEQ ID NO: 25951 - DNA, 20 bp, Artificial Sequence
  Description of Artificial Sequence: Synthetic oligonucleotide
  Target: FXN; (-) strand; PAM type: YTN; PAM sequence: CTA
aataccatatttttatataa

SEQ ID NO: 25952 - DNA, 20 bp, Artificial Sequence
  Description of Artificial Sequence: Synthetic oligonucleotide
  Target: FXN; (-) strand; PAM type: YTN; PAM sequence: CTA
aaaataataatactaaatac

SEQ ID NO: 25953 - DNA, 20 bp, Artificial Sequence
  Description of Artificial Sequence: Synthetic oligonucleotide
  Target: FXN; (-) strand; PAM type: YTN; PAM sequence: CTC
taaaaataataatactaaat

SEQ ID NO: 25954 - DNA, 20 bp, Artificial Sequence
  Description of Artificial Sequence: Synthetic oligonucleotide
  Target: FXN; (-) strand; PAM type: YTN; PAM sequence: CTG
tctctaaaaataataatact

SEQ ID NO: 25955 - DNA, 20 bp, Artificial Sequence
  Description of Artificial Sequence: Synthetic oligonucleotide
  Target: FXN; (-) strand; PAM type: YTN; PAM sequence: CTG
ggtgacagagcgaggccctg

SEQ ID NO: 25956 - DNA, 20 bp, Artificial Sequence
  Description of Artificial Sequence: Synthetic oligonucleotide
  Target: FXN; (-) strand; PAM type: YTN; PAM sequence: CTC
cagcctgggtgacagagcga

SEQ ID NO: 25957 - DNA, 20 bp, Artificial Sequence
  Description of Artificial Sequence: Synthetic oligonucleotide
  Target: FXN; (-) strand; PAM type: YTN; PAM sequence: CTG
cactccagcctgggtgacag

SEQ ID NO: 25958 - DNA, 20 bp, Artificial Sequence
  Description of Artificial Sequence: Synthetic oligonucleotide
  Target: FXN; (-) strand; PAM type: YTN; PAM sequence: TTG
tgccactgcactccagcctg

SEQ ID NO: 25959 - DNA, 20 bp, Artificial Sequence
  Description of Artificial Sequence: Synthetic oligonucleotide
  Target: FXN; (-) strand; PAM type: YTN; PAM sequence: CTA
tgattgtgccactgcactcc

SEQ ID NO: 25960 - DNA, 20 bp, Artificial Sequence
  Description of Artificial Sequence: Synthetic oligonucleotide
  Target: FXN; (-) strand; PAM type: YTN; PAM sequence: CTG
cagtgagctatgattgtgcc

SEQ ID NO: 25961 - DNA, 20 bp, Artificial Sequence
  Description of Artificial Sequence: Synthetic oligonucleotide
  Target: FXN; (-) strand; PAM type: YTN; PAM sequence: TTG
aggctgcagtgagctatgat

SEQ ID NO: 25962 - DNA, 20 bp, Artificial Sequence
  Description of Artificial Sequence: Synthetic oligonucleotide
  Target: FXN; (-) strand; PAM type: YTN; PAM sequence: CTT
gaggctgcagtgagctatga

SEQ ID NO: 25963 - DNA, 20 bp, Artificial Sequence
  Description of Artificial Sequence: Synthetic oligonucleotide
  Target: FXN; (-) strand; PAM type: YTN; PAM sequence: TTG
agcccagaagcttgaggctg

SEQ ID NO: 25964 - DNA, 20 bp, Artificial Sequence
  Description of Artificial Sequence: Synthetic oligonucleotide
  Target: FXN; (-) strand; PAM type: YTN; PAM sequence: CTT
gagcccagaagcttgaggct

SEQ ID NO: 25965 - DNA, 20 bp, Artificial Sequence
  Description of Artificial Sequence: Synthetic oligonucleotide
  Target: FXN; (-) strand; PAM type: YTN; PAM sequence: CTG
aggtggaacgatcacttgag

SEQ ID NO: 25966 - DNA, 20 bp, Artificial Sequence
  Description of Artificial Sequence: Synthetic oligonucleotide
  Target: FXN; (-) strand; PAM type: YTN; PAM sequence: CTA
gggaggctgaggtggaacga

SEQ ID NO: 25967 - DNA, 20 bp, Artificial Sequence
  Description of Artificial Sequence: Synthetic oligonucleotide
  Target: FXN; (-) strand; PAM type: YTN; PAM sequence: CTA
ctagggaggctgaggtggaa

SEQ ID NO: 25968 - DNA, 20 bp, Artificial Sequence
  Description of Artificial Sequence: Synthetic oligonucleotide
  Target: FXN; (-) strand; PAM type: YTN; PAM sequence: CTG
tagtcccagctactagggag

SEQ ID NO: 25969 - DNA, 20 bp, Artificial Sequence
  Description of Artificial Sequence: Synthetic oligonucleotide
  Target: FXN; (-) strand; PAM type: YTN; PAM sequence: TTA
gccgagtatggtggcatgtg

SEQ ID NO: 25970 - DNA, 20 bp, Artificial Sequence
  Description of Artificial Sequence: Synthetic oligonucleotide
  Target: FXN; (-) strand; PAM type: YTN; PAM sequence: CTG
ggaaacatagcgagacccat

SEQ ID NO: 25971 - DNA, 20 bp, Artificial Sequence
  Description of Artificial Sequence: Synthetic oligonucleotide
  Target: FXN; (-) strand; PAM type: YTN; PAM sequence: TTG
agaccagcctgggaaacata

SEQ ID NO: 25972 - DNA, 20 bp, Artificial Sequence
  Description of Artificial Sequence: Synthetic oligonucleotide
  Target: FXN; (-) strand; PAM type: YTN; PAM sequence: TTT
gagaccagcctgggaaacat

SEQ ID NO: 25973 - DNA, 20 bp, Artificial Sequence
  Description of Artificial Sequence: Synthetic oligonucleotide
  Target: FXN; (-) strand; PAM type: YTN; PAM sequence: TTG
aggccaggagtttgagacca

SEQ ID NO: 25974 - DNA, 20 bp, Artificial Sequence
  Description of Artificial Sequence: Synthetic oligonucleotide
  Target: FXN; (-) strand; PAM type: YTN; PAM sequence: CTT
gaggccaggagtttgagacc

SEQ ID NO: 25975 - DNA, 20 bp, Artificial Sequence
  Description of Artificial Sequence: Synthetic oligonucleotide
  Target: FXN; (-) strand; PAM type: YTN; PAM sequence: TTG
ggaggccgaggtgagagaat

SEQ ID NO: 25976 - DNA, 20 bp, Artificial Sequence
  Description of Artificial Sequence: Synthetic oligonucleotide
  Target: FXN; (-) strand; PAM type: YTN; PAM sequence: TTT
gggaggccgaggtgagagaa

SEQ ID NO: 25977 - DNA, 20 bp, Artificial Sequence
  Description of Artificial Sequence: Synthetic oligonucleotide
  Target: FXN; (-) strand; PAM type: YTN; PAM sequence: CTT
tgggaggccgaggtgagaga

SEQ ID NO: 25978 - DNA, 20 bp, Artificial Sequence
  Description of Artificial Sequence: Synthetic oligonucleotide
  Target: FXN; (-) strand; PAM type: YTN; PAM sequence: CTG
taatcccggtgctttgggag

SEQ ID NO: 25979 - DNA, 20 bp, Artificial Sequence
  Description of Artificial Sequence: Synthetic oligonucleotide
  Target: FXN; (-) strand; PAM type: YTN; PAM sequence: CTG
gcacacacctgtaatcccgg

SEQ ID NO: 25980 - DNA, 20 bp, Artificial Sequence
  Description of Artificial Sequence: Synthetic oligonucleotide
  Target: FXN; (-) strand; PAM type: YTN; PAM sequence: CTG
ggtgtgctggcacacacctg

SEQ ID NO: 25981 - DNA, 20 bp, Artificial Sequence
  Description of Artificial Sequence: Synthetic oligonucleotide
  Target: FXN; (-) strand; PAM type: YTN; PAM sequence: TTG
tggctgggtgtgctggcaca

SEQ ID NO: 25982 - DNA, 20 bp, Artificial Sequence
  Description of Artificial Sequence: Synthetic oligonucleotide
  Target: FXN; (-) strand; PAM type: YTN; PAM sequence: TTT
gtggctgggtgtgctggcac

SEQ ID NO: 25983 - DNA, 20 bp, Artificial Sequence
  Description of Artificial Sequence: Synthetic oligonucleotide
  Target: FXN; (-) strand; PAM type: YTN; PAM sequence: TTA
tagatttgtggctgggtgtg

SEQ ID NO: 25984 - DNA, 20 bp, Artificial Sequence
  Description of Artificial Sequence: Synthetic oligonucleotide
  Target: FXN; (-) strand; PAM type: YTN; PAM sequence: TTT
atagatttgtggctgggtgt

SEQ ID NO: 25985 - DNA, 20 bp, Artificial Sequence
  Description of Artificial Sequence: Synthetic oligonucleotide
  Target: FXN; (-) strand; PAM type: YTN; PAM sequence: CTA
aatttatagatttgtggctg

SEQ ID NO: 25986 - DNA, 20 bp, Artificial Sequence
  Description of Artificial Sequence: Synthetic oligonucleotide
  Target: FXN; (-) strand; PAM type: YTN; PAM sequence: TTC
taaatttatagatttgtggc

SEQ ID NO: 25987 - DNA, 20 bp, Artificial Sequence
  Description of Artificial Sequence: Synthetic oligonucleotide
  Target: FXN; (-) strand; PAM type: YTN; PAM sequence: TTT
ctaaatttatagatttgtgg

SEQ ID NO: 25988 - DNA, 20 bp, Artificial Sequence
  Description of Artificial Sequence: Synthetic oligonucleotide
  Target: FXN; (-) strand; PAM type: YTN; PAM sequence: CTT
tctaaatttatagatttgtg

SEQ ID NO: 25989 - DNA, 20 bp, Artificial Sequence
  Description of Artificial Sequence: Synthetic oligonucleotide
  Target: FXN; (-) strand; PAM type: YTN; PAM sequence: CTC
ctttctaaatttatagattt

SEQ ID NO: 25990 - DNA, 20 bp, Artificial Sequence
  Description of Artificial Sequence: Synthetic oligonucleotide
  Target: FXN; (-) strand; PAM type: YTN; PAM sequence: TTA
gaaatagtcctcctttctaa

SEQ ID NO: 25991 - DNA, 20 bp, Artificial Sequence
  Description of Artificial Sequence: Synthetic oligonucleotide
  Target: FXN; (-) strand; PAM type: YTN; PAM sequence: TTT
agaaatagtcctcctttcta

SEQ ID NO: 25992 - DNA, 20 bp, Artificial Sequence
  Description of Artificial Sequence: Synthetic oligonucleotide
  Target: FXN; (-) strand; PAM type: YTN; PAM sequence: CTT
tagaaatagtcctcctttct

SEQ ID NO: 25993 - DNA, 20 bp, Artificial Sequence
  Description of Artificial Sequence: Synthetic oligonucleotide
  Target: FXN; (-) strand; PAM type: YTN; PAM sequence: CTC
tttagaaatagtcctccttt

SEQ ID NO: 25994 - DNA, 20 bp, Artificial Sequence
  Description of Artificial Sequence: Synthetic oligonucleotide
  Target: FXN; (-) strand; PAM type: YTN; PAM sequence: CTA
caggtagtgggaccctcttt

SEQ ID NO: 25995 - DNA, 20 bp, Artificial Sequence
  Description of Artificial Sequence: Synthetic oligonucleotide
  Target: FXN; (-) strand; PAM type: YTN; PAM sequence: CTG
cctacaggtagtgggaccct

SEQ ID NO: 25996 - DNA, 20 bp, Artificial Sequence
  Description of Artificial Sequence: Synthetic oligonucleotide
  Target: FXN; (-) strand; PAM type: YTN; PAM sequence: TTC
ctgcctacaggtagtgggac

SEQ ID NO: 25997 - DNA, 20 bp, Artificial Sequence
  Description of Artificial Sequence: Synthetic oligonucleotide
  Target: FXN; (-) strand; PAM type: YTN; PAM sequence: CTT
cctgcctacaggtagtggga

SEQ ID NO: 25998 - DNA, 20 bp, Artificial Sequence
  Description of Artificial Sequence: Synthetic oligonucleotide
  Target: FXN; (-) strand; PAM type: YTN; PAM sequence: CTG
cttcctgcctacaggtagtg

SEQ ID NO: 25999 - DNA, 20 bp, Artificial Sequence
  Description of Artificial Sequence: Synthetic oligonucleotide
  Target: FXN; (-) strand; PAM type: YTN; PAM sequence: CTC
tgcttcctgcctacaggtag

SEQ ID NO: 26000 - DNA, 20 bp, Artificial Sequence
  Description of Artificial Sequence: Synthetic oligonucleotide
  Target: FXN; (-) strand; PAM type: YTN; PAM sequence: TTA
tggccagaggctctgcttcc

SEQ ID NO: 26001 - DNA, 20 bp, Artificial Sequence
  Description of Artificial Sequence: Synthetic oligonucleotide
  Target: FXN; (-) strand; PAM type: YTN; PAM sequence: TTC
agttatggccagaggctctg

SEQ ID NO: 26002 - DNA, 20 bp, Artificial Sequence
  Description of Artificial Sequence: Synthetic oligonucleotide
  Target: FXN; (-) strand; PAM type: YTN; PAM sequence: TTT
cagttatggccagaggctct

SEQ ID NO: 26003 - DNA, 20 bp, Artificial Sequence
  Description of Artificial Sequence: Synthetic oligonucleotide
  Target: FXN; (-) strand; PAM type: YTN; PAM sequence: TTT
tcagttatggccagaggctc

SEQ ID NO: 26004 - DNA, 20 bp, Artificial Sequence
  Description of Artificial Sequence: Synthetic oligonucleotide
  Target: FXN; (-) strand; PAM type: YTN; PAM sequence: TTT
ttcagttatggccagaggct

SEQ ID NO: 26005 - DNA, 20 bp, Artificial Sequence
  Description of Artificial Sequence: Synthetic oligonucleotide
  Target: FXN; (-) strand; PAM type: YTN; PAM sequence: TTG
tttttcagttatggccagag

SEQ ID NO: 26006 - DNA, 20 bp, Artificial Sequence
  Description of Artificial Sequence: Synthetic oligonucleotide
  Target: FXN; (-) strand; PAM type: YTN; PAM sequence: CTT
gtttttcagttatggccaga

SEQ ID NO: 26007 - DNA, 20 bp, Artificial Sequence
  Description of Artificial Sequence: Synthetic oligonucleotide
  Target: FXN; (-) strand; PAM type: YTN; PAM sequence: TTG
gaagtgcttgtttttcagtt

SEQ ID NO: 26008 - DNA, 20 bp, Artificial Sequence
  Description of Artificial Sequence: Synthetic oligonucleotide
  Target: FXN; (-) strand; PAM type: YTN; PAM sequence: CTT
ggaagtgcttgtttttcagt

SEQ ID NO: 26009 - DNA, 20 bp, Artificial Sequence
  Description of Artificial Sequence: Synthetic oligonucleotide
  Target: FXN; (-) strand; PAM type: YTN; PAM sequence: TTC
ttggaagtgcttgtttttca

SEQ ID NO: 26010 - DNA, 20 bp, Artificial Sequence
  Description of Artificial Sequence: Synthetic oligonucleotide
  Target: FXN; (-) strand; PAM type: YTN; PAM sequence: CTT
cttggaagtgcttgtttttc

SEQ ID NO: 26011 - DNA, 20 bp, Artificial Sequence
  Description of Artificial Sequence: Synthetic oligonucleotide
  Target: FXN; (-) strand; PAM type: YTN; PAM sequence: TTG
ccccttcttggaagtgcttg

SEQ ID NO: 26012 - DNA, 20 bp, Artificial Sequence
  Description of Artificial Sequence: Synthetic oligonucleotide
  Target: FXN; (-) strand; PAM type: YTN; PAM sequence: TTT
gccccttcttggaagtgctt

SEQ ID NO: 26013 - DNA, 20 bp, Artificial Sequence
  Description of Artificial Sequence: Synthetic oligonucleotide
  Target: FXN; (-) strand; PAM type: YTN; PAM sequence: CTT
tgccccttcttggaagtgct

SEQ ID NO: 26014 - DNA, 20 bp, Artificial Sequence
  Description of Artificial Sequence: Synthetic oligonucleotide
  Target: FXN; (-) strand; PAM type: YTN; PAM sequence: TTC
cctttgccccttcttggaag

SEQ ID NO: 26015 - DNA, 20 bp, Artificial Sequence
  Description of Artificial Sequence: Synthetic oligonucleotide
  Target: FXN; (-) strand; PAM type: YTN; PAM sequence: TTC
atgttccctttgccccttct

SEQ ID NO: 26016 - DNA, 20 bp, Artificial Sequence
  Description of Artificial Sequence: Synthetic oligonucleotide
  Target: FXN; (-) strand; PAM type: YTN; PAM sequence: CTC
agcataaattcatgttccct

SEQ ID NO: 26017 - DNA, 20 bp, Artificial Sequence
  Description of Artificial Sequence: Synthetic oligonucleotide
  Target: FXN; (-) strand; PAM type: YTN; PAM sequence: CTC
tcagcataaattcatgttcc

SEQ ID NO: 26018 - DNA, 20 bp, Artificial Sequence
  Description of Artificial Sequence: Synthetic oligonucleotide
  Target: FXN; (-) strand; PAM type: YTN; PAM sequence: CTA
cgcctctcagcataaattca

SEQ ID NO: 26019 - DNA, 20 bp, Artificial Sequence
  Description of Artificial Sequence: Synthetic oligonucleotide
  Target: FXN; (-) strand; PAM type: YTN; PAM sequence: TTA
gctacgcctctcagcataaa

SEQ ID NO: 26020 - DNA, 20 bp, Artificial Sequence
  Description of Artificial Sequence: Synthetic oligonucleotide
  Target: FXN; (-) strand; PAM type: YTN; PAM sequence: CTT
agctacgcctctcagcataa

SEQ ID NO: 26021 - DNA, 20 bp, Artificial Sequence
  Description of Artificial Sequence: Synthetic oligonucleotide
  Target: FXN; (-) strand; PAM type: YTN; PAM sequence: TTG
aatatgtatgcttagctacg

SEQ ID NO: 26022 - DNA, 20 bp, Artificial Sequence
  Description of Artificial Sequence: Synthetic oligonucleotide
  Target: FXN; (-) strand; PAM type: YTN; PAM sequence: CTG
ttgaatatgtatgcttagct

SEQ ID NO: 26023 - DNA, 20 bp, Artificial Sequence
  Description of Artificial Sequence: Synthetic oligonucleotide
  Target: FXN; (-) strand; PAM type: YTN; PAM sequence: CTC
ccataatctgttgaatatgt

SEQ ID NO: 26024 - DNA, 20 bp, Artificial Sequence
  Description of Artificial Sequence: Synthetic oligonucleotide
  Target: FXN; (-) strand; PAM type: YTN; PAM sequence: TTC
atagatcctcccataatctg

SEQ ID NO: 26025 - DNA, 20 bp, Artificial Sequence
  Description of Artificial Sequence: Synthetic oligonucleotide
  Target: FXN; (-) strand; PAM type: YTN; PAM sequence: TTG
tgaatattcatagatcctcc

SEQ ID NO: 26026 - DNA, 20 bp, Artificial Sequence
  Description of Artificial Sequence: Synthetic oligonucleotide
  Target: FXN; (-) strand; PAM type: YTN; PAM sequence: TTT
gtgaatattcatagatcctc

SEQ ID NO: 26027 - DNA, 20 bp, Artificial Sequence
  Description of Artificial Sequence: Synthetic oligonucleotide
  Target: FXN; (-) strand; PAM type: YTN; PAM sequence: CTT
tgtgaatattcatagatcct

SEQ ID NO: 26028 - DNA, 20 bp, Artificial Sequence
  Description of Artificial Sequence: Synthetic oligonucleotide
  Target: FXN; (-) strand; PAM type: YTN; PAM sequence: CTC
cctttgtgaatattcataga

SEQ ID NO: 26029 - DNA, 20 bp, Artificial Sequence
  Description of Artificial Sequence: Synthetic oligonucleotide
  Target: FXN; (-) strand; PAM type: YTN; PAM sequence: TTC
atagatcctccctttgtgaa

SEQ ID NO: 26030 - DNA, 20 bp, Artificial Sequence
  Description of Artificial Sequence: Synthetic oligonucleotide
  Target: FXN; (-) strand; PAM type: YTN; PAM sequence: CTC
cacatgtgtgcatattcata

SEQ ID NO: 26031 - DNA, 20 bp, Artificial Sequence
  Description of Artificial Sequence: Synthetic oligonucleotide
  Target: FXN; (-) strand; PAM type: YTN; PAM sequence: TTA
ctccacatgtgtgcatattc

SEQ ID NO: 26032 - DNA, 20 bp, Artificial Sequence
  Description of Artificial Sequence: Synthetic oligonucleotide
  Target: FXN; (-) strand; PAM type: YTN; PAM sequence: CTT
actccacatgtgtgcatatt

SEQ ID NO: 26033 - DNA, 20 bp, Artificial Sequence
  Description of Artificial Sequence: Synthetic oligonucleotide
  Target: FXN; (-) strand; PAM type: YTN; PAM sequence: TTA
gcttactccacatgtgtgca

SEQ ID NO: 26034 - DNA, 20 bp, Artificial Sequence
  Description of Artificial Sequence: Synthetic oligonucleotide
  Target: FXN; (-) strand; PAM type: YTN; PAM sequence: CTG
cacacgttagcttactccac

SEQ ID NO: 26035 - DNA, 20 bp, Artificial Sequence
  Description of Artificial Sequence: Synthetic oligonucleotide
  Target: FXN; (-) strand; PAM type: YTN; PAM sequence: CTA
aggtgaacatgggagacatg

SEQ ID NO: 26036 - DNA, 20 bp, Artificial Sequence
  Description of Artificial Sequence: Synthetic oligonucleotide
  Target: FXN; (-) strand; PAM type: YTN; PAM sequence: CTG
cctaaggtgaacatgggaga

SEQ ID NO: 26037 - DNA, 20 bp, Artificial Sequence
  Description of Artificial Sequence: Synthetic oligonucleotide
  Target: FXN; (-) strand; PAM type: YTN; PAM sequence: TTC
tgcctaaggtgaacatggga

SEQ ID NO: 26038 - DNA, 20 bp, Artificial Sequence
  Description of Artificial Sequence: Synthetic oligonucleotide
  Target: FXN; (-) strand; PAM type: YTN; PAM sequence: TTT
ctgcctaaggtgaacatggg

SEQ ID NO: 26039 - DNA, 20 bp, Artificial Sequence
  Description of Artificial Sequence: Synthetic oligonucleotide
  Target: FXN; (-) strand; PAM type: YTN; PAM sequence: TTA
agtttctgcctaaggtgaac

SEQ ID NO: 26040 - DNA, 20 bp, Artificial Sequence
  Description of Artificial Sequence: Synthetic oligonucleotide
  Target: FXN; (-) strand; PAM type: YTN; PAM sequence: TTA
gtgttaagtttctgcctaag

SEQ ID NO: 26041 - DNA, 20 bp, Artificial Sequence
  Description of Artificial Sequence: Synthetic oligonucleotide
  Target: FXN; (-) strand; PAM type: YTN; PAM sequence: CTG
taatacatgttagtgttaag

SEQ ID NO: 26042 - DNA, 20 bp, Artificial Sequence
  Description of Artificial Sequence: Synthetic oligonucleotide
  Target: FXN; (-) strand; PAM type: YTN; PAM sequence: TTG
ccctgtaatacatgttagtg

SEQ ID NO: 26043 - DNA, 20 bp, Artificial Sequence
  Description of Artificial Sequence: Synthetic oligonucleotide
  Target: FXN; (-) strand; PAM type: YTN; PAM sequence: TTG
ttgccctgtaatacatgtta

SEQ ID NO: 26044 - DNA, 20 bp, Artificial Sequence
  Description of Artificial Sequence: Synthetic oligonucleotide
  Target: FXN; (-) strand; PAM type: YTN; PAM sequence: TTT
gttgccctgtaatacatgtt

SEQ ID NO: 26045 - DNA, 20 bp, Artificial Sequence
  Description of Artificial Sequence: Synthetic oligonucleotide
  Target: FXN; (-) strand; PAM type: YTN; PAM sequence: TTT
tgttgccctgtaatacatgt

SEQ ID NO: 26046 - DNA, 20 bp, Artificial Sequence
  Description of Artificial Sequence: Synthetic oligonucleotide
  Target: FXN; (-) strand; PAM type: YTN; PAM sequence: CTC
attttgttgccctgtaatac

SEQ ID NO: 26047 - DNA, 20 bp, Artificial Sequence
  Description of Artificial Sequence: Synthetic oligonucleotide
  Target: FXN; (-) strand; PAM type: YTN; PAM sequence: TTA
tgtagatatgcagtctcatt

SEQ ID NO: 26048 - DNA, 20 bp, Artificial Sequence
  Description of Artificial Sequence: Synthetic oligonucleotide
  Target: FXN; (-) strand; PAM type: YTN; PAM sequence: CTA
ggttatgtagatatgcagtc

SEQ ID NO: 26049 - DNA, 20 bp, Artificial Sequence
  Description of Artificial Sequence: Synthetic oligonucleotide
  Target: FXN; (-) strand; PAM type: YTN; PAM sequence: CTA
ccaaatagctaggttatgta

SEQ ID NO: 26050 - DNA, 20 bp, Artificial Sequence
  Description of Artificial Sequence: Synthetic oligonucleotide
  Target: FXN; (-) strand; PAM type: YTN; PAM sequence: TTC
agcctaccaaatagctaggt

SEQ ID NO: 26051 - DNA, 20 bp, Artificial Sequence
  Description of Artificial Sequence: Synthetic oligonucleotide
  Target: FXN; (-) strand; PAM type: YTN; PAM sequence: CTT
cagcctaccaaatagctagg

SEQ ID NO: 26052 - DNA, 20 bp, Artificial Sequence
  Description of Artificial Sequence: Synthetic oligonucleotide
  Target: FXN; (-) strand; PAM type: YTN; PAM sequence: CTG
cttcagcctaccaaatagct

SEQ ID NO: 26053 - DNA, 20 bp, Artificial Sequence
  Description of Artificial Sequence: Synthetic oligonucleotide
  Target: FXN; (-) strand; PAM type: YTN; PAM sequence: CTC
ctgcttcagcctaccaaata

SEQ ID NO: 26054 - DNA, 20 bp, Artificial Sequence
  Description of Artificial Sequence: Synthetic oligonucleotide
  Target: FXN; (-) strand; PAM type: YTN; PAM sequence: TTA
agtgatgctcctgcttcagc

SEQ ID NO: 26055 - DNA, 20 bp, Artificial Sequence
  Description of Artificial Sequence: Synthetic oligonucleotide
  Target: FXN; (-) strand; PAM type: YTN; PAM sequence: CTT
aagtgatgctcctgcttcag

SEQ ID NO: 26056 - DNA, 20 bp, Artificial Sequence
  Description of Artificial Sequence: Synthetic oligonucleotide
  Target: FXN; (-) strand; PAM type: YTN; PAM sequence: CTC
ccagtcttaagtgatgctcc

SEQ ID NO: 26057 - DNA, 20 bp, Artificial Sequence
  Description of Artificial Sequence: Synthetic oligonucleotide
  Target: FXN; (-) strand; PAM type: YTN; PAM sequence: CTC
gaactcccagtcttaagtga

SEQ ID NO: 26058 - DNA, 20 bp, Artificial Sequence
  Description of Artificial Sequence: Synthetic oligonucleotide
  Target: FXN; (-) strand; PAM type: YTN; PAM sequence: CTG
cctcgaactcccagtcttaa

SEQ ID NO: 26059 - DNA, 20 bp, Artificial Sequence
  Description of Artificial Sequence: Synthetic oligonucleotide
  Target: FXN; (-) strand; PAM type: YTN; PAM sequence: CTC
acagctgcctcgaactccca

SEQ ID NO: 26060 - DNA, 20 bp, Artificial Sequence
  Description of Artificial Sequence: Synthetic oligonucleotide
  Target: FXN; (-) strand; PAM type: YTN; PAM sequence: CTG
gagaacagtggtgcgatcat

SEQ ID NO: 26061 - DNA, 20 bp, Artificial Sequence
  Description of Artificial Sequence: Synthetic oligonucleotide
  Target: FXN; (-) strand; PAM type: YTN; PAM sequence: CTG
gctggagaacagtggtgcga

SEQ ID NO: 26062 - DNA, 20 bp, Artificial Sequence
  Description of Artificial Sequence: Synthetic oligonucleotide
  Target: FXN; (-) strand; PAM type: YTN; PAM sequence: CTG
tcatcctggctggagaacag

SEQ ID NO: 26063 - DNA, 20 bp, Artificial Sequence
  Description of Artificial Sequence: Synthetic oligonucleotide
  Target: FXN; (-) strand; PAM type: YTN; PAM sequence: TTG
ccctgtcatcctggctggag

SEQ ID NO: 26064 - DNA, 20 bp, Artificial Sequence
  Description of Artificial Sequence: Synthetic oligonucleotide
  Target: FXN; (-) strand; PAM type: YTN; PAM sequence: CTT
gccctgtcatcctggctgga

SEQ ID NO: 26065 - DNA, 20 bp, Artificial Sequence
  Description of Artificial Sequence: Synthetic oligonucleotide
  Target: FXN; (-) strand; PAM type: YTN; PAM sequence: CTA
agacagggtcttgccctgtc

SEQ ID NO: 26066 - DNA, 20 bp, Artificial Sequence
  Description of Artificial Sequence: Synthetic oligonucleotide
  Target: FXN; (-) strand; PAM type: YTN; PAM sequence: CTG
accacagagtggtctaagac

SEQ ID NO: 26067 - DNA, 20 bp, Artificial Sequence
  Description of Artificial Sequence: Synthetic oligonucleotide
  Target: FXN; (-) strand; PAM type: YTN; PAM sequence: CTG
ataaccactgaccacagagt

SEQ ID NO: 26068 - DNA, 20 bp, Artificial Sequence
  Description of Artificial Sequence: Synthetic oligonucleotide
  Target: FXN; (-) strand; PAM type: YTN; PAM sequence: TTC
ctgataaccactgaccacag

SEQ ID NO: 26069 - DNA, 20 bp, Artificial Sequence
  Description of Artificial Sequence: Synthetic oligonucleotide
  Target: FXN; (-) strand; PAM type: YTN; PAM sequence: CTT
cctgataaccactgaccaca

SEQ ID NO: 26070 - DNA, 20 bp, Artificial Sequence
  Description of Artificial Sequence: Synthetic oligonucleotide
  Target: FXN; (-) strand; PAM type: YTN; PAM sequence: TTC
cttcctgataaccactgacc

SEQ ID NO: 26071 - DNA, 20 bp, Artificial Sequence
  Description of Artificial Sequence: Synthetic oligonucleotide
  Target: FXN; (-) strand; PAM type: YTN; PAM sequence: CTA
gcattccttcctgataacca

SEQ ID NO: 26072 - DNA, 20 bp, Artificial Sequence
  Description of Artificial Sequence: Synthetic oligonucleotide
  Target: FXN; (-) strand; PAM type: YTN; PAM sequence: CTG
actagcattccttcctgata

SEQ ID NO: 26073 - DNA, 20 bp, Artificial Sequence
  Description of Artificial Sequence: Synthetic oligonucleotide
  Target: FXN; (-) strand; PAM type: YTN; PAM sequence: TTC
agcacaactgactagcattc

SEQ ID NO: 26074 - DNA, 20 bp, Artificial Sequence
  Description of Artificial Sequence: Synthetic oligonucleotide
  Target: FXN; (-) strand; PAM type: YTN; PAM sequence: TTT
cagcacaactgactagcatt

SEQ ID NO: 26075 - DNA, 20 bp, Artificial Sequence
  Description of Artificial Sequence: Synthetic oligonucleotide
  Target: FXN; (-) strand; PAM type: YTN; PAM sequence: TTA
gtggtttcagcacaactgac

SEQ ID NO: 26076 - DNA, 20 bp, Artificial Sequence
  Description of Artificial Sequence: Synthetic oligonucleotide
  Target: FXN; (-) strand; PAM type: YTN; PAM sequence: TTT
agtggtttcagcacaactga

SEQ ID NO: 26077 - DNA, 20 bp, Artificial Sequence
  Description of Artificial Sequence: Synthetic oligonucleotide
  Target: FXN; (-) strand; PAM type: YTN; PAM sequence: TTT
tagtggtttcagcacaactg

SEQ ID NO: 26078 - DNA, 20 bp, Artificial Sequence
  Description of Artificial Sequence: Synthetic oligonucleotide
  Target: FXN; (-) strand; PAM type: YTN; PAM sequence: TTT
ttagtggtttcagcacaact

SEQ ID NO: 26079 - DNA, 20 bp, Artificial Sequence
  Description of Artificial Sequence: Synthetic oligonucleotide
  Target: FXN; (-) strand; PAM type: YTN; PAM sequence: CTT
tttagtggtttcagcacaac

SEQ ID NO: 26080 - DNA, 20 bp, Artificial Sequence
  Description of Artificial Sequence: Synthetic oligonucleotide
  Target: FXN; (-) strand; PAM type: YTN; PAM sequence: TTC
ctttttagtggtttcagcac

SEQ ID NO: 26081 - DNA, 20 bp, Artificial Sequence
  Description of Artificial Sequence: Synthetic oligonucleotide
  Target: FXN; (-) strand; PAM type: YTN; PAM sequence: CTT
cctttttagtggtttcagca

SEQ ID NO: 26082 - DNA, 20 bp, Artificial Sequence
  Description of Artificial Sequence: Synthetic oligonucleotide
  Target: FXN; (-) strand; PAM type: YTN; PAM sequence: CTG
cccttcctttttagtggttt

SEQ ID NO: 26083 - DNA, 20 bp, Artificial Sequence
  Description of Artificial Sequence: Synthetic oligonucleotide
  Target: FXN; (-) strand; PAM type: YTN; PAM sequence: TTC
tgcccttcctttttagtggt

SEQ ID NO: 26084 - DNA, 20 bp, Artificial Sequence
  Description of Artificial Sequence: Synthetic oligonucleotide
  Target: FXN; (-) strand; PAM type: YTN; PAM sequence: CTA
attctgcccttcctttttag

SEQ ID NO: 26085 - DNA, 20 bp, Artificial Sequence
  Description of Artificial Sequence: Synthetic oligonucleotide
  Target: FXN; (-) strand; PAM type: YTN; PAM sequence: CTC
atcacctaattctgcccttc

SEQ ID NO: 26086 - DNA, 20 bp, Artificial Sequence
  Description of Artificial Sequence: Synthetic oligonucleotide
  Target: FXN; (-) strand; PAM type: YTN; PAM sequence: CTG
gtatcaactcatcacctaat

SEQ ID NO: 26087 - DNA, 20 bp, Artificial Sequence
  Description of Artificial Sequence: Synthetic oligonucleotide
  Target: FXN; (-) strand; PAM type: YTN; PAM sequence: TTC
accactggtatcaactcatc

SEQ ID NO: 26088 - DNA, 20 bp, Artificial Sequence
  Description of Artificial Sequence: Synthetic oligonucleotide
  Target: FXN; (-) strand; PAM type: YTN; PAM sequence: CTT
caccactggtatcaactcat

SEQ ID NO: 26089 - DNA, 20 bp, Artificial Sequence
  Description of Artificial Sequence: Synthetic oligonucleotide
  Target: FXN; (-) strand; PAM type: YTN; PAM sequence: CTC
acttcaccactggtatcaac

SEQ ID NO: 26090 - DNA, 20 bp, Artificial Sequence
  Description of Artificial Sequence: Synthetic oligonucleotide
  Target: FXN; (-) strand; PAM type: YTN; PAM sequence: CTC
aaaaagaaaaaaaaaaaaaa

SEQ ID NO: 26091 - DNA, 20 bp, Artificial Sequence
  Description of Artificial Sequence: Synthetic oligonucleotide
  Target: FXN; (-) strand; PAM type: YTN; PAM sequence: CTC
catctcaaaaagaaaaaaaa

SEQ ID NO: 26092 - DNA, 20 bp, Artificial Sequence
  Description of Artificial Sequence: Synthetic oligonucleotide
  Target: FXN; (-) strand; PAM type: YTN; PAM sequence: CTG
ggcaacagagcaagactcca

SEQ ID NO: 26093 - DNA, 20 bp, Artificial Sequence
  Description of Artificial Sequence: Synthetic oligonucleotide
  Target: FXN; (-) strand; PAM type: YTN; PAM sequence: CTC
cagcctgggcaacagagcaa

SEQ ID NO: 26094 - DNA, 20 bp, Artificial Sequence
  Description of Artificial Sequence: Synthetic oligonucleotide
  Target: FXN; (-) strand; PAM type: YTN; PAM sequence: CTA
cactccagcctgggcaacag

SEQ ID NO: 26095 - DNA, 20 bp, Artificial Sequence
  Description of Artificial Sequence: Synthetic oligonucleotide
  Target: FXN; (-) strand; PAM type: YTN; PAM sequence: CTG
agatcacaccactacactcc

SEQ ID NO: 26096 - DNA, 20 bp, Artificial Sequence
  Description of Artificial Sequence: Synthetic oligonucleotide
  Target: FXN; (-) strand; PAM type: YTN; PAM sequence: TTG
cgatgagctgagatcacacc

SEQ ID NO: 26097 - DNA, 20 bp, Artificial Sequence
  Description of Artificial Sequence: Synthetic oligonucleotide
  Target: FXN; (-) strand; PAM type: YTN; PAM sequence: TTG
aacccaggaggtggaggttg

SEQ ID NO: 26098 - DNA, 20 bp, Artificial Sequence
  Description of Artificial Sequence: Synthetic oligonucleotide
  Target: FXN; (-) strand; PAM type: YTN; PAM sequence: CTT
gaacccaggaggtggaggtt

SEQ ID NO: 26099 - DNA, 20 bp, Artificial Sequence
  Description of Artificial Sequence: Synthetic oligonucleotide
  Target: FXN; (-) strand; PAM type: YTN; PAM sequence: CTG
aggcaagagaatcacttgaa

SEQ ID NO: 26100 - DNA, 20 bp, Artificial Sequence
  Description of Artificial Sequence: Synthetic oligonucleotide
  Target: FXN; (-) strand; PAM type: YTN; PAM sequence: CTC
gggaggctgaggcaagagaa

SEQ ID NO: 26101 - DNA, 20 bp, Artificial Sequence
  Description of Artificial Sequence: Synthetic oligonucleotide
  Target: FXN; (-) strand; PAM type: YTN; PAM sequence: CTA
ctcgggaggctgaggcaaga

SEQ ID NO: 26102 - DNA, 20 bp, Artificial Sequence
  Description of Artificial Sequence: Synthetic oligonucleotide
  Target: FXN; (-) strand; PAM type: YTN; PAM sequence: CTG
taatcccagctactcgggag

SEQ ID NO: 26103 - DNA, 20 bp, Artificial Sequence
  Description of Artificial Sequence: Synthetic oligonucleotide
  Target: FXN; (-) strand; PAM type: YTN; PAM sequence: TTA
gccaggcgtggtggcaggcg

SEQ ID NO: 26104 - DNA, 20 bp, Artificial Sequence
  Description of Artificial Sequence: Synthetic oligonucleotide
  Target: FXN; (-) strand; PAM type: YTN; PAM sequence: CTA
aaaatataaaaaaattagcc

SEQ ID NO: 26105 - DNA, 20 bp, Artificial Sequence
  Description of Artificial Sequence: Synthetic oligonucleotide
  Target: FXN; (-) strand; PAM type: YTN; PAM sequence: CTA
ctaaaaatataaaaaaatta

SEQ ID NO: 26106 - DNA, 20 bp, Artificial Sequence
  Description of Artificial Sequence: Synthetic oligonucleotide
  Target: FXN; (-) strand; PAM type: YTN; PAM sequence: CTC
tactaaaaatataaaaaaat

SEQ ID NO: 26107 - DNA, 20 bp, Artificial Sequence
  Description of Artificial Sequence: Synthetic oligonucleotide
  Target: FXN; (-) strand; PAM type: YTN; PAM sequence: CTG
acaacatggcaaaacccagt

SEQ ID NO: 26108 - DNA, 20 bp, Artificial Sequence
  Description of Artificial Sequence: Synthetic oligonucleotide
  Target: FXN; (-) strand; PAM type: YTN; PAM sequence: CTA
gcctgacaacatggcaaaac

SEQ ID NO: 26109 - DNA, 20 bp, Artificial Sequence
  Description of Artificial Sequence: Synthetic oligonucleotide
  Target: FXN; (-) strand; PAM type: YTN; PAM sequence: TTC
aagactagcctgacaacatg

SEQ ID NO: 26110 - DNA, 20 bp, Artificial Sequence
  Description of Artificial Sequence: Synthetic oligonucleotide
  Target: FXN; (-) strand; PAM type: YTN; PAM sequence: CTG
aggtcaggagttcaagacta

SEQ ID NO: 26111 - DNA, 20 bp, Artificial Sequence
  Description of Artificial Sequence: Synthetic oligonucleotide
  Target: FXN; (-) strand; PAM type: YTN; PAM sequence: TTA
cctgaggtcaggagttcaag

SEQ ID NO: 26112 - DNA, 20 bp, Artificial Sequence
  Description of Artificial Sequence: Synthetic oligonucleotide
  Target: FXN; (-) strand; PAM type: YTN; PAM sequence: TTG
gattacctgaggtcaggagt

SEQ ID NO: 26113 - DNA, 20 bp, Artificial Sequence
  Description of Artificial Sequence: Synthetic oligonucleotide
  Target: FXN; (-) strand; PAM type: YTN; PAM sequence: TTG
ggaggccaaagcagttggat

SEQ ID NO: 26114 - DNA, 20 bp, Artificial Sequence
  Description of Artificial Sequence: Synthetic oligonucleotide
  Target: FXN; (-) strand; PAM type: YTN; PAM sequence: TTT
gggaggccaaagcagttgga

SEQ ID NO: 26115 - DNA, 20 bp, Artificial Sequence
  Description of Artificial Sequence: Synthetic oligonucleotide
  Target: FXN; (-) strand; PAM type: YTN; PAM sequence: CTT
tgggaggccaaagcagttgg

SEQ ID NO: 26116 - DNA, 20 bp, Artificial Sequence
  Description of Artificial Sequence: Synthetic oligonucleotide
  Target: FXN; (-) strand; PAM type: YTN; PAM sequence: CTG
taatcccagcactttgggag

SEQ ID NO: 26117 - DNA, 20 bp, Artificial Sequence
  Description of Artificial Sequence: Synthetic oligonucleotide
  Target: FXN; (-) strand; PAM type: YTN; PAM sequence: CTG
cctgtaatcccagcactttg

SEQ ID NO: 26118 - DNA, 20 bp, Artificial Sequence
  Description of Artificial Sequence: Synthetic oligonucleotide
  Target: FXN; (-) strand; PAM type: YTN; PAM sequence: TTG
gagctgcctgtaatcccagc

SEQ ID NO: 26119 - DNA, 20 bp, Artificial Sequence
  Description of Artificial Sequence: Synthetic oligonucleotide
  Target: FXN; (-) strand; PAM type: YTN; PAM sequence: TTT
ggagctgcctgtaatcccag

SEQ ID NO: 26120 - DNA, 20 bp, Artificial Sequence
  Description of Artificial Sequence: Synthetic oligonucleotide
  Target: FXN; (-) strand; PAM type: YTN; PAM sequence: CTT
tggagctgcctgtaatccca

SEQ ID NO: 26121 - DNA, 20 bp, Artificial Sequence
  Description of Artificial Sequence: Synthetic oligonucleotide
  Target: FXN; (-) strand; PAM type: YTN; PAM sequence: CTG
taatcccagcactttggagc

SEQ ID NO: 26122 - DNA, 20 bp, Artificial Sequence
  Description of Artificial Sequence: Synthetic oligonucleotide
  Target: FXN; (-) strand; PAM type: YTN; PAM sequence: CTC
atgcctgtaatcccagcact

SEQ ID NO: 26123 - DNA, 20 bp, Artificial Sequence
  Description of Artificial Sequence: Synthetic oligonucleotide
  Target: FXN; (-) strand; PAM type: YTN; PAM sequence: TTC
aggccatgcatggtggctca

SEQ ID NO: 26124 - DNA, 20 bp, Artificial Sequence
  Description of Artificial Sequence: Synthetic oligonucleotide
  Target: FXN; (-) strand; PAM type: YTN; PAM sequence: TTT
caggccatgcatggtggctc

SEQ ID NO: 26125 - DNA, 20 bp, Artificial Sequence
  Description of Artificial Sequence: Synthetic oligonucleotide
  Target: FXN; (-) strand; PAM type: YTN; PAM sequence: TTA
tttcaggccatgcatggtgg

SEQ ID NO: 26126 - DNA, 20 bp, Artificial Sequence
  Description of Artificial Sequence: Synthetic oligonucleotide
  Target: FXN; (-) strand; PAM type: YTN; PAM sequence: TTC
aaaaaaattatttcaggcca

SEQ ID NO: 26127 - DNA, 20 bp, Artificial Sequence
  Description of Artificial Sequence: Synthetic oligonucleotide
  Target: FXN; (-) strand; PAM type: YTN; PAM sequence: TTT
caaaaaaattatttcaggcc

SEQ ID NO: 26128 - DNA, 20 bp, Artificial Sequence
  Description of Artificial Sequence: Synthetic oligonucleotide
  Target: FXN; (-) strand; PAM type: YTN; PAM sequence: CTT
tcaaaaaaattatttcaggc

SEQ ID NO: 26129 - DNA, 20 bp, Artificial Sequence
  Description of Artificial Sequence: Synthetic oligonucleotide
  Target: FXN; (-) strand; PAM type: YTN; PAM sequence: CTA
gccctttcaaaaaaattatt

SEQ ID NO: 26130 - DNA, 20 bp, Artificial Sequence
  Description of Artificial Sequence: Synthetic oligonucleotide
  Target: FXN; (-) strand; PAM type: YTN; PAM sequence: CTA
aatagaaactagccctttca

SEQ ID NO: 26131 - DNA, 20 bp, Artificial Sequence
  Description of Artificial Sequence: Synthetic oligonucleotide
  Target: FXN; (-) strand; PAM type: YTN; PAM sequence: CTA
agggctaaatagaaactagc

SEQ ID NO: 26132 - DNA, 20 bp, Artificial Sequence
  Description of Artificial Sequence: Synthetic oligonucleotide
  Target: FXN; (-) strand; PAM type: YTN; PAM sequence: TTC
ccctaagggctaaatagaaa

SEQ ID NO: 26133 - DNA, 20 bp, Artificial Sequence
  Description of Artificial Sequence: Synthetic oligonucleotide
  Target: FXN; (-) strand; PAM type: YTN; PAM sequence: TTT
cccctaagggctaaatagaa

SEQ ID NO: 26134 - DNA, 20 bp, Artificial Sequence
  Description of Artificial Sequence: Synthetic oligonucleotide
  Target: FXN; (-) strand; PAM type: YTN; PAM sequence: TTT
tcccctaagggctaaataga

SEQ ID NO: 26135 - DNA, 20 bp, Artificial Sequence
  Description of Artificial Sequence: Synthetic oligonucleotide
  Target: FXN; (-) strand; PAM type: YTN; PAM sequence: TTT
ttcccctaagggctaaatag

SEQ ID NO: 26136 - DNA, 20 bp, Artificial Sequence
  Description of Artificial Sequence: Synthetic oligonucleotide
  Target: FXN; (-) strand; PAM type: YTN; PAM sequence: TTT
tttcccctaagggctaaata

SEQ ID NO: 26137 - DNA, 20 bp, Artificial Sequence
  Description of Artificial Sequence: Synthetic oligonucleotide
  Target: FXN; (-) strand; PAM type: YTN; PAM sequence: TTT
ttttcccctaagggctaaat

SEQ ID NO: 26138 - DNA, 20 bp, Artificial Sequence
  Description of Artificial Sequence: Synthetic oligonucleotide
  Target: FXN; (-) strand; PAM type: YTN; PAM sequence: TTT
tttttcccctaagggctaaa

SEQ ID NO: 26139 - DNA, 20 bp, Artificial Sequence
  Description of Artificial Sequence: Synthetic oligonucleotide
  Target: FXN; (-) strand; PAM type: YTN; PAM sequence: TTA
gttttttttcccctaagggc

SEQ ID NO: 26140 - DNA, 20 bp, Artificial Sequence
  Description of Artificial Sequence: Synthetic oligonucleotide
  Target: FXN; (-) strand; PAM type: YTN; PAM sequence: CTG
ccattagttttttttcccct

SEQ ID NO: 26141 - DNA, 20 bp, Artificial Sequence
  Description of Artificial Sequence: Synthetic oligonucleotide
  Target: FXN; (-) strand; PAM type: YTN; PAM sequence: CTA
actgccattagttttttttc

SEQ ID NO: 26142 - DNA, 20 bp, Artificial Sequence
  Description of Artificial Sequence: Synthetic oligonucleotide
  Target: FXN; (-) strand; PAM type: YTN; PAM sequence: CTC
cctaactgccattagttttt

SEQ ID NO: 26143 - DNA, 20 bp, Artificial Sequence
  Description of Artificial Sequence: Synthetic oligonucleotide
  Target: FXN; (-) strand; PAM type: YTN; PAM sequence: TTC
cctccctaactgccattagt

SEQ ID NO: 26144 - DNA, 20 bp, Artificial Sequence
  Description of Artificial Sequence: Synthetic oligonucleotide
  Target: FXN; (-) strand; PAM type: YTN; PAM sequence: CTA
ttccctccctaactgccatt

SEQ ID NO: 26145 - DNA, 20 bp, Artificial Sequence
  Description of Artificial Sequence: Synthetic oligonucleotide
  Target: FXN; (-) strand; PAM type: YTN; PAM sequence: TTC
tattccctccctaactgcca

SEQ ID NO: 26146 - DNA, 20 bp, Artificial Sequence
  Description of Artificial Sequence: Synthetic oligonucleotide
  Target: FXN; (-) strand; PAM type: YTN; PAM sequence: CTC
gttctattccctccctaact

SEQ ID NO: 26147 - DNA, 20 bp, Artificial Sequence
  Description of Artificial Sequence: Synthetic oligonucleotide
  Target: FXN; (-) strand; PAM type: YTN; PAM sequence: TTC
aaacaggactcgttctattc

SEQ ID NO: 26148 - DNA, 20 bp, Artificial Sequence
  Description of Artificial Sequence: Synthetic oligonucleotide
  Target: FXN; (-) strand; PAM type: YTN; PAM sequence: TTG
gccatgatgggaaaggagtt

SEQ ID NO: 26149 - DNA, 20 bp, Artificial Sequence
  Description of Artificial Sequence: Synthetic oligonucleotide
  Target: FXN; (-) strand; PAM type: YTN; PAM sequence: TTT
ggccatgatgggaaaggagt

SEQ ID NO: 26150 - DNA, 20 bp, Artificial Sequence
  Description of Artificial Sequence: Synthetic oligonucleotide
  Target: FXN; (-) strand; PAM type: YTN; PAM sequence: TTT
tggccatgatgggaaaggag

SEQ ID NO: 26151 - DNA, 20 bp, Artificial Sequence
  Description of Artificial Sequence: Synthetic oligonucleotide
  Target: FXN; (-) strand; PAM type: YTN; PAM sequence: TTA
agttttggccatgatgggaa

SEQ ID NO: 26152 - DNA, 20 bp, Artificial Sequence
  Description of Artificial Sequence: Synthetic oligonucleotide
  Target: FXN; (-) strand; PAM type: YTN; PAM sequence: TTT
aagttttggccatgatggga

SEQ ID NO: 26153 - DNA, 20 bp, Artificial Sequence
  Description of Artificial Sequence: Synthetic oligonucleotide
  Target: FXN; (-) strand; PAM type: YTN; PAM sequence: TTT
taagttttggccatgatggg

SEQ ID NO: 26154 - DNA, 20 bp, Artificial Sequence
  Description of Artificial Sequence: Synthetic oligonucleotide
  Target: FXN; (-) strand; PAM type: YTN; PAM sequence: CTA
aaaaaaattttaagttttgg

SEQ ID NO: 26155 - DNA, 20 bp, Artificial Sequence
  Description of Artificial Sequence: Synthetic oligonucleotide
  Target: FXN; (-) strand; PAM type: YTN; PAM sequence: TTG
gccaaggggagcccagagat

SEQ ID NO: 26156 - DNA, 20 bp, Artificial Sequence
  Description of Artificial Sequence: Synthetic oligonucleotide
  Target: FXN; (-) strand; PAM type: YTN; PAM sequence: TTT
ggccaaggggagcccagaga

SEQ ID NO: 26157 - DNA, 20 bp, Artificial Sequence
  Description of Artificial Sequence: Synthetic oligonucleotide
  Target: FXN; (-) strand; PAM type: YTN; PAM sequence: TTT
tggccaaggggagcccagag

SEQ ID NO: 26158 - DNA, 20 bp, Artificial Sequence
  Description of Artificial Sequence: Synthetic oligonucleotide
  Target: FXN; (-) strand; PAM type: YTN; PAM sequence: CTT
ttggccaaggggagcccaga

SEQ ID NO: 26159 - DNA, 20 bp, Artificial Sequence
  Description of Artificial Sequence: Synthetic oligonucleotide
  Target: FXN; (-) strand; PAM type: YTN; PAM sequence: CTA
tcttttggccaaggggagcc

SEQ ID NO: 26160 - DNA, 20 bp, Artificial Sequence
  Description of Artificial Sequence: Synthetic oligonucleotide
  Target: FXN; (-) strand; PAM type: YTN; PAM sequence: CTC
aacaaactatcttttggcca

SEQ ID NO: 26161 - DNA, 20 bp, Artificial Sequence
  Description of Artificial Sequence: Synthetic oligonucleotide
  Target: FXN; (-) strand; PAM type: YTN; PAM sequence: CTG
actcaacaaactatcttttg

SEQ ID NO: 26162 - DNA, 20 bp, Artificial Sequence
  Description of Artificial Sequence: Synthetic oligonucleotide
  Target: FXN; (-) strand; PAM type: YTN; PAM sequence: CTC
ccaactgactcaacaaacta

SEQ ID NO: 26163 - DNA, 20 bp, Artificial Sequence
  Description of Artificial Sequence: Synthetic oligonucleotide
  Target: FXN; (-) strand; PAM type: YTN; PAM sequence: CTA
agctcccaactgactcaaca

SEQ ID NO: 26164 - DNA, 20 bp, Artificial Sequence
  Description of Artificial Sequence: Synthetic oligonucleotide
  Target: FXN; (-) strand; PAM type: YTN; PAM sequence: TTC
taagctcccaactgactcaa

SEQ ID NO: 26165 - DNA, 20 bp, Artificial Sequence
  Description of Artificial Sequence: Synthetic oligonucleotide
  Target: FXN; (-) strand; PAM type: YTN; PAM sequence: TTC
aatgatgtgagaaataaaaa

SEQ ID NO: 26166 - DNA, 20 bp, Artificial Sequence
  Description of Artificial Sequence: Synthetic oligonucleotide
  Target: FXN; (-) strand; PAM type: YTN; PAM sequence: TTG
attcaatgatgtgagaaata

SEQ ID NO: 26167 - DNA, 20 bp, Artificial Sequence
  Description of Artificial Sequence: Synthetic oligonucleotide
  Target: FXN; (-) strand; PAM type: YTN; PAM sequence: TTC
aaattgattcaatgatgtga

SEQ ID NO: 26168 - DNA, 20 bp, Artificial Sequence
  Description of Artificial Sequence: Synthetic oligonucleotide
  Target: FXN; (-) strand; PAM type: YTN; PAM sequence: CTG
gttcaaattgattcaatgat

SEQ ID NO: 26169 - DNA, 20 bp, Artificial Sequence
  Description of Artificial Sequence: Synthetic oligonucleotide
  Target: FXN; (-) strand; PAM type: YTN; PAM sequence: TTG
tcgcctggttcaaattgatt

SEQ ID NO: 26170 - DNA, 20 bp, Artificial Sequence
  Description of Artificial Sequence: Synthetic oligonucleotide
  Target: FXN; (-) strand; PAM type: YTN; PAM sequence: TTT
gtcgcctggttcaaattgat

SEQ ID NO: 26171 - DNA, 20 bp, Artificial Sequence
  Description of Artificial Sequence: Synthetic oligonucleotide
  Target: FXN; (-) strand; PAM type: YTN; PAM sequence: TTT
tgtcgcctggttcaaattga

SEQ ID NO: 26172 - DNA, 20 bp, Artificial Sequence
  Description of Artificial Sequence: Synthetic oligonucleotide
  Target: FXN; (-) strand; PAM type: YTN; PAM sequence: CTG
ggagcagaaggttttgtcgc

SEQ ID NO: 26173 - DNA, 20 bp, Artificial Sequence
  Description of Artificial Sequence: Synthetic oligonucleotide
  Target: FXN; (-) strand; PAM type: YTN; PAM sequence: CTA
ctgggagcagaaggttttgt

SEQ ID NO: 26174 - DNA, 20 bp, Artificial Sequence
  Description of Artificial Sequence: Synthetic oligonucleotide
  Target: FXN; (-) strand; PAM type: YTN; PAM sequence: CTG
acccactactgggagcagaa

SEQ ID NO: 26175 - DNA, 20 bp, Artificial Sequence
  Description of Artificial Sequence: Synthetic oligonucleotide
  Target: FXN; (-) strand; PAM type: YTN; PAM sequence: CTC
tgacccactactgggagcag

SEQ ID NO: 26176 - DNA, 20 bp, Artificial Sequence
  Description of Artificial Sequence: Synthetic oligonucleotide
  Target: FXN; (-) strand; PAM type: YTN; PAM sequence: TTC
tctgacccactactgggagc

SEQ ID NO: 26177 - DNA, 20 bp, Artificial Sequence
  Description of Artificial Sequence: Synthetic oligonucleotide
  Target: FXN; (-) strand; PAM type: YTN; PAM sequence: CTC
agggcaggaatcaggaaggt

SEQ ID NO: 26178 - DNA, 20 bp, Artificial Sequence
  Description of Artificial Sequence: Synthetic oligonucleotide
  Target: FXN; (-) strand; PAM type: YTN; PAM sequence: TTC
agagagacaatctcagggca

SEQ ID NO: 26179 - DNA, 20 bp, Artificial Sequence
  Description of Artificial Sequence: Synthetic oligonucleotide
  Target: FXN; (-) strand; PAM type: YTN; PAM sequence: CTT
cagagagacaatctcagggc

SEQ ID NO: 26180 - DNA, 20 bp, Artificial Sequence
  Description of Artificial Sequence: Synthetic oligonucleotide
  Target: FXN; (-) strand; PAM type: YTN; PAM sequence: TTG
tcttcagagagacaatctca

SEQ ID NO: 26181 - DNA, 20 bp, Artificial Sequence
  Description of Artificial Sequence: Synthetic oligonucleotide
  Target: FXN; (-) strand; PAM type: YTN; PAM sequence: CTA
atgttgtcttcagagagaca

SEQ ID NO: 26182 - DNA, 20 bp, Artificial Sequence
  Description of Artificial Sequence: Synthetic oligonucleotide
  Target: FXN; (-) strand; PAM type: YTN; PAM sequence: CTA
gcctaatgttgtcttcagag

SEQ ID NO: 26183 - DNA, 20 bp, Artificial Sequence
  Description of Artificial Sequence: Synthetic oligonucleotide
  Target: FXN; (-) strand; PAM type: YTN; PAM sequence: CTA
ctagcctaatgttgtcttca

SEQ ID NO: 26184 - DNA, 20 bp, Artificial Sequence
  Description of Artificial Sequence: Synthetic oligonucleotide
  Target: FXN; (-) strand; PAM type: YTN; PAM sequence: CTG
gaaagcctactagcctaatg

SEQ ID NO: 26185 - DNA, 20 bp, Artificial Sequence
  Description of Artificial Sequence: Synthetic oligonucleotide
  Target: FXN; (-) strand; PAM type: YTN; PAM sequence: TTA
cagaatctggaaagcctact

SEQ ID NO: 26186 - DNA, 20 bp, Artificial Sequence
  Description of Artificial Sequence: Synthetic oligonucleotide
  Target: FXN; (-) strand; PAM type: YTN; PAM sequence: TTG
aaagaatgggttacagaatc

SEQ ID NO: 26187 - DNA, 20 bp, Artificial Sequence
  Description of Artificial Sequence: Synthetic oligonucleotide
  Target: FXN; (-) strand; PAM type: YTN; PAM sequence: TTT
gaaagaatgggttacagaat

SEQ ID NO: 26188 - DNA, 20 bp, Artificial Sequence
  Description of Artificial Sequence: Synthetic oligonucleotide
  Target: FXN; (-) strand; PAM type: YTN; PAM sequence: CTT
tgaaagaatgggttacagaa

SEQ ID NO: 26189 - DNA, 20 bp, Artificial Sequence
  Description of Artificial Sequence: Synthetic oligonucleotide
  Target: FXN; (-) strand; PAM type: YTN; PAM sequence: TTC
ctttgaaagaatgggttaca

SEQ ID NO: 26190 - DNA, 20 bp, Artificial Sequence
  Description of Artificial Sequence: Synthetic oligonucleotide
  Target: FXN; (-) strand; PAM type: YTN; PAM sequence: CTT
cctttgaaagaatgggttac

SEQ ID NO: 26191 - DNA, 20 bp, Artificial Sequence
  Description of Artificial Sequence: Synthetic oligonucleotide
  Target: FXN; (-) strand; PAM type: YTN; PAM sequence: CTC
ttcctttgaaagaatgggtt

SEQ ID NO: 26192 - DNA, 20 bp, Artificial Sequence
  Description of Artificial Sequence: Synthetic oligonucleotide
  Target: FXN; (-) strand; PAM type: YTN; PAM sequence: CTA
gaaaaatataggcatctctt

SEQ ID NO: 26193 - DNA, 20 bp, Artificial Sequence
  Description of Artificial Sequence: Synthetic oligonucleotide
  Target: FXN; (-) strand; PAM type: YTN; PAM sequence: TTG
gctagaaaaatataggcatc

SEQ ID NO: 26194 - DNA, 20 bp, Artificial Sequence
  Description of Artificial Sequence: Synthetic oligonucleotide
  Target: FXN; (-) strand; PAM type: YTN; PAM sequence: CTC
aaggtatatgaattggctag

SEQ ID NO: 26195 - DNA, 20 bp, Artificial Sequence
  Description of Artificial Sequence: Synthetic oligonucleotide
  Target: FXN; (-) strand; PAM type: YTN; PAM sequence: TTG
agtgatactcaaggtatatg

SEQ ID NO: 26196 - DNA, 20 bp, Artificial Sequence
  Description of Artificial Sequence: Synthetic oligonucleotide
  Target: FXN; (-) strand; PAM type: YTN; PAM sequence: CTT
gagtgatactcaaggtatat

SEQ ID NO: 26197 - DNA, 20 bp, Artificial Sequence
  Description of Artificial Sequence: Synthetic oligonucleotide
  Target: FXN; (-) strand; PAM type: YTN; PAM sequence: TTG
cccttgagtgatactcaagg

SEQ ID NO: 26198 - DNA, 20 bp, Artificial Sequence
  Description of Artificial Sequence: Synthetic oligonucleotide
  Target: FXN; (-) strand; PAM type: YTN; PAM sequence: TTT
gcccttgagtgatactcaag

SEQ ID NO: 26199 - DNA, 20 bp, Artificial Sequence
  Description of Artificial Sequence: Synthetic oligonucleotide
  Target: FXN; (-) strand; PAM type: YTN; PAM sequence: TTT
tgcccttgagtgatactcaa

SEQ ID NO: 26200 - DNA, 20 bp, Artificial Sequence
  Description of Artificial Sequence: Synthetic oligonucleotide
  Target: FXN; (-) strand; PAM type: YTN; PAM sequence: TTA
gaaataattttgcccttgag

SEQ ID NO: 26201 - DNA, 20 bp, Artificial Sequence
  Description of Artificial Sequence: Synthetic oligonucleotide
  Target: FXN; (-) strand; PAM type: YTN; PAM sequence: TTG
ttagaaataattttgccctt

SEQ ID NO: 26202 - DNA, 20 bp, Artificial Sequence
  Description of Artificial Sequence: Synthetic oligonucleotide
  Target: FXN; (-) strand; PAM type: YTN; PAM sequence: TTT
gttagaaataattttgccct

SEQ ID NO: 26203 - DNA, 20 bp, Artificial Sequence
  Description of Artificial Sequence: Synthetic oligonucleotide
  Target: FXN; (-) strand; PAM type: YTN; PAM sequence: TTA
gtaaatgatttgttagaaat

SEQ ID NO: 26204 - DNA, 20 bp, Artificial Sequence
  Description of Artificial Sequence: Synthetic oligonucleotide
  Target: FXN; (-) strand; PAM type: YTN; PAM sequence: CTA
attagtaaatgatttgttag

SEQ ID NO: 26205 - DNA, 20 bp, Artificial Sequence
  Description of Artificial Sequence: Synthetic oligonucleotide
  Target: FXN; (-) strand; PAM type: YTN; PAM sequence: TTG
ctaattagtaaatgatttgt

SEQ ID NO: 26206 - DNA, 20 bp, Artificial Sequence
  Description of Artificial Sequence: Synthetic oligonucleotide
  Target: FXN; (-) strand; PAM type: YTN; PAM sequence: TTT
gctaattagtaaatgatttg

SEQ ID NO: 26207 - DNA, 20 bp, Artificial Sequence
  Description of Artificial Sequence: Synthetic oligonucleotide
  Target: FXN; (-) strand; PAM type: YTN; PAM sequence: TTA
agcatttgctaattagtaaa

SEQ ID NO: 26208 - DNA, 20 bp, Artificial Sequence
  Description of Artificial Sequence: Synthetic oligonucleotide
  Target: FXN; (-) strand; PAM type: YTN; PAM sequence: CTT
aagcatttgctaattagtaa

SEQ ID NO: 26209 - DNA, 20 bp, Artificial Sequence
  Description of Artificial Sequence: Synthetic oligonucleotide
  Target: FXN; (-) strand; PAM type: YTN; PAM sequence: CTA
cacttaagcatttgctaatt

SEQ ID NO: 26210 - DNA, 20 bp, Artificial Sequence
  Description of Artificial Sequence: Synthetic oligonucleotide
  Target: FXN; (-) strand; PAM type: YTN; PAM sequence: CTA
aatctacacttaagcatttg

SEQ ID NO: 26211 - DNA, 20 bp, Artificial Sequence
  Description of Artificial Sequence: Synthetic oligonucleotide
  Target: FXN; (-) strand; PAM type: YTN; PAM sequence: TTC
taaatctacacttaagcatt

SEQ ID NO: 26212 - DNA, 20 bp, Artificial Sequence
  Description of Artificial Sequence: Synthetic oligonucleotide
  Target: FXN; (-) strand; PAM type: YTN; PAM sequence: TTT
ctaaatctacacttaagcat

SEQ ID NO: 26213 - DNA, 20 bp, Artificial Sequence
  Description of Artificial Sequence: Synthetic oligonucleotide
  Target: FXN; (-) strand; PAM type: YTN; PAM sequence: CTT
tctaaatctacacttaagca

SEQ ID NO: 26214 - DNA, 20 bp, Artificial Sequence
  Description of Artificial Sequence: Synthetic oligonucleotide
  Target: FXN; (-) strand; PAM type: YTN; PAM sequence: TTA
gctttctaaatctacactta

SEQ ID NO: 26215 - DNA, 20 bp, Artificial Sequence
  Description of Artificial Sequence: Synthetic oligonucleotide
  Target: FXN; (-) strand; PAM type: YTN; PAM sequence: TTT
agctttctaaatctacactt

SEQ ID NO: 26216 - DNA, 20 bp, Artificial Sequence
  Description of Artificial Sequence: Synthetic oligonucleotide
  Target: FXN; (-) strand; PAM type: YTN; PAM sequence: CTT
tagctttctaaatctacact

SEQ ID NO: 26217 - DNA, 20 bp, Artificial Sequence
  Description of Artificial Sequence: Synthetic oligonucleotide
  Target: FXN; (-) strand; PAM type: YTN; PAM sequence: CTG
tatagctttagctttctaaa

SEQ ID NO: 26218 - DNA, 20 bp, Artificial Sequence
  Description of Artificial Sequence: Synthetic oligonucleotide
  Target: FXN; (-) strand; PAM type: YTN; PAM sequence: CTA
tagatggcagccactgtata

SEQ ID NO: 26219 - DNA, 20 bp, Artificial Sequence
  Description of Artificial Sequence: Synthetic oligonucleotide
  Target: FXN; (-) strand; PAM type: YTN; PAM sequence: TTA
atcacaagtccaaactatag

SEQ ID NO: 26220 - DNA, 20 bp, Artificial Sequence
  Description of Artificial Sequence: Synthetic oligonucleotide
  Target: FXN; (-) strand; PAM type: YTN; PAM sequence: TTC
aatgtagttaatcacaagtc

SEQ ID NO: 26221 - DNA, 20 bp, Artificial Sequence
  Description of Artificial Sequence: Synthetic oligonucleotide
  Target: FXN; (-) strand; PAM type: YTN; PAM sequence: TTT
caatgtagttaatcacaagt

SEQ ID NO: 26222 - DNA, 20 bp, Artificial Sequence
  Description of Artificial Sequence: Synthetic oligonucleotide
  Target: FXN; (-) strand; PAM type: YTN; PAM sequence: TTA
gcatttcaatgtagttaatc

SEQ ID NO: 26223 - DNA, 20 bp, Artificial Sequence
  Description of Artificial Sequence: Synthetic oligonucleotide
  Target: FXN; (-) strand; PAM type: YTN; PAM sequence: CTA
gggtacagagttagcatttc

SEQ ID NO: 26224 - DNA, 20 bp, Artificial Sequence
  Description of Artificial Sequence: Synthetic oligonucleotide
  Target: FXN; (-) strand; PAM type: YTN; PAM sequence: CTC
tagggtacagagttagcatt

SEQ ID NO: 26225 - DNA, 20 bp, Artificial Sequence
  Description of Artificial Sequence: Synthetic oligonucleotide
  Target: FXN; (-) strand; PAM type: YTN; PAM sequence: TTC
atactctagggtacagagtt

SEQ ID NO: 26226 - DNA, 20 bp, Artificial Sequence
  Description of Artificial Sequence: Synthetic oligonucleotide
  Target: FXN; (-) strand; PAM type: YTN; PAM sequence: CTA
atcaggaattcatactctag

SEQ ID NO: 26227 - DNA, 20 bp, Artificial Sequence
  Description of Artificial Sequence: Synthetic oligonucleotide
  Target: FXN; (-) strand; PAM type: YTN; PAM sequence: CTC
taatcaggaattcatactct

SEQ ID NO: 26228 - DNA, 20 bp, Artificial Sequence
  Description of Artificial Sequence: Synthetic oligonucleotide
  Target: FXN; (-) strand; PAM type: YTN; PAM sequence: CTG
aaggactctaatcaggaatt

SEQ ID NO: 26229 - DNA, 20 bp, Artificial Sequence
  Description of Artificial Sequence: Synthetic oligonucleotide
  Target: FXN; (-) strand; PAM type: YTN; PAM sequence: TTA
gcacctgaaggactctaatc

SEQ ID NO: 26230 - DNA, 20 bp, Artificial Sequence
  Description of Artificial Sequence: Synthetic oligonucleotide
  Target: FXN; (-) strand; PAM type: YTN; PAM sequence: TTA
gttagcacctgaaggactct

SEQ ID NO: 26231 - DNA, 20 bp, Artificial Sequence
  Description of Artificial Sequence: Synthetic oligonucleotide
  Target: FXN; (-) strand; PAM type: YTN; PAM sequence: TTA
tcaaacatgaaatacataaa

SEQ ID NO: 26232 - DNA, 20 bp, Artificial Sequence
  Description of Artificial Sequence: Synthetic oligonucleotide
  Target: FXN; (-) strand; PAM type: YTN; PAM sequence: CTC
aagtaataatattatcaaac

SEQ ID NO: 26233 - DNA, 20 bp, Artificial Sequence
  Description of Artificial Sequence: Synthetic oligonucleotide
  Target: FXN; (-) strand; PAM type: YTN; PAM sequence: CTC
ccacaaagctcaagtaataa

SEQ ID NO: 26234 - DNA, 20 bp, Artificial Sequence
  Description of Artificial Sequence: Synthetic oligonucleotide
  Target: FXN; (-) strand; PAM type: YTN; PAM sequence: CTC
tcccacaaagctcaagtaat

SEQ ID NO: 26235 - DNA, 20 bp, Artificial Sequence
  Description of Artificial Sequence: Synthetic oligonucleotide
  Target: FXN; (-) strand; PAM type: YTN; PAM sequence: CTG
ctctcccacaaagctcaagt

SEQ ID NO: 26236 - DNA, 20 bp, Artificial Sequence
  Description of Artificial Sequence: Synthetic oligonucleotide
  Target: FXN; (-) strand; PAM type: YTN; PAM sequence: CTC
aggggaggaaaagactgctc

SEQ ID NO: 26237 - DNA, 20 bp, Artificial Sequence
  Description of Artificial Sequence: Synthetic oligonucleotide
  Target: FXN; (-) strand; PAM type: YTN; PAM sequence: CTA
tatctcaggggaggaaaaga

SEQ ID NO: 26238 - DNA, 20 bp, Artificial Sequence
  Description of Artificial Sequence: Synthetic oligonucleotide
  Target: FXN; (-) strand; PAM type: YTN; PAM sequence: CTA
gctatatctcaggggaggaa

SEQ ID NO: 26239 - DNA, 20 bp, Artificial Sequence
  Description of Artificial Sequence: Synthetic oligonucleotide
  Target: FXN; (-) strand; PAM type: YTN; PAM sequence: TTC
tagctatatctcaggggagg

SEQ ID NO: 26240 - DNA, 20 bp, Artificial Sequence
  Description of Artificial Sequence: Synthetic oligonucleotide
  Target: FXN; (-) strand; PAM type: YTN; PAM sequence: CTT
ctagctatatctcaggggag

SEQ ID NO: 26241 - DNA, 20 bp, Artificial Sequence
  Description of Artificial Sequence: Synthetic oligonucleotide
  Target: FXN; (-) strand; PAM type: YTN; PAM sequence: TTC
acaaaggaggtaacttctag

SEQ ID NO: 26242 - DNA, 20 bp, Artificial Sequence
  Description of Artificial Sequence: Synthetic oligonucleotide
  Target: FXN; (-) strand; PAM type: YTN; PAM sequence: CTT
cacaaaggaggtaacttcta

SEQ ID NO: 26243 - DNA, 20 bp, Artificial Sequence
  Description of Artificial Sequence: Synthetic oligonucleotide
  Target: FXN; (-) strand; PAM type: YTN; PAM sequence: CTA
ggaaggcttcacaaaggagg

SEQ ID NO: 26244 - DNA, 20 bp, Artificial Sequence
  Description of Artificial Sequence: Synthetic oligonucleotide
  Target: FXN; (-) strand; PAM type: YTN; PAM sequence: TTG
gagtatctaggaaggcttca

SEQ ID NO: 26245 - DNA, 20 bp, Artificial Sequence
  Description of Artificial Sequence: Synthetic oligonucleotide
  Target: FXN; (-) strand; PAM type: YTN; PAM sequence: CTT
ggagtatctaggaaggcttc

SEQ ID NO: 26246 - DNA, 20 bp, Artificial Sequence
  Description of Artificial Sequence: Synthetic oligonucleotide
  Target: FXN; (-) strand; PAM type: YTN; PAM sequence: CTG
cttggagtatctaggaaggc

SEQ ID NO: 26247 - DNA, 20 bp, Artificial Sequence
  Description of Artificial Sequence: Synthetic oligonucleotide
  Target: FXN; (-) strand; PAM type: YTN; PAM sequence: CTG
ggcaagggagaaaggaagga

SEQ ID NO: 26248 - DNA, 20 bp, Artificial Sequence
  Description of Artificial Sequence: Synthetic oligonucleotide
  Target: FXN; (-) strand; PAM type: YTN; PAM sequence: CTC
agagtgctgggcaagggaga

SEQ ID NO: 26249 - DNA, 20 bp, Artificial Sequence
  Description of Artificial Sequence: Synthetic oligonucleotide
  Target: FXN; (-) strand; PAM type: YTN; PAM sequence: CTC
cacagagtcaacctcagagt

SEQ ID NO: 26250 - DNA, 20 bp, Artificial Sequence
  Description of Artificial Sequence: Synthetic oligonucleotide
  Target: FXN; (-) strand; PAM type: YTN; PAM sequence: TTA
taacacagagggatcagtgc

SEQ ID NO: 26251 - DNA, 20 bp, Artificial Sequence
  Description of Artificial Sequence: Synthetic oligonucleotide
  Target: FXN; (-) strand; PAM type: YTN; PAM sequence: CTG
acgtgtaaatagacaattat

SEQ ID NO: 26252 - DNA, 20 bp, Artificial Sequence
  Description of Artificial Sequence: Synthetic oligonucleotide
  Target: FXN; (-) strand; PAM type: YTN; PAM sequence: TTA
taggtggtagctgacgtgta

SEQ ID NO: 26253 - DNA, 20 bp, Artificial Sequence
  Description of Artificial Sequence: Synthetic oligonucleotide
  Target: FXN; (-) strand; PAM type: YTN; PAM sequence: CTC
agtgtgttataggtggtagc

SEQ ID NO: 26254 - DNA, 20 bp, Artificial Sequence
  Description of Artificial Sequence: Synthetic oligonucleotide
  Target: FXN; (-) strand; PAM type: YTN; PAM sequence: TTG
aggaactcagtgtgttatag

SEQ ID NO: 26255 - DNA, 20 bp, Artificial Sequence
  Description of Artificial Sequence: Synthetic oligonucleotide
  Target: FXN; (-) strand; PAM type: YTN; PAM sequence: CTG
ttgaggaactcagtgtgtta

SEQ ID NO: 26256 - DNA, 20 bp, Artificial Sequence
  Description of Artificial Sequence: Synthetic oligonucleotide
  Target: FXN; (-) strand; PAM type: YTN; PAM sequence: CTG
ctgttgaggaactcagtgtg

SEQ ID NO: 26257 - DNA, 20 bp, Artificial Sequence
  Description of Artificial Sequence: Synthetic oligonucleotide
  Target: FXN; (-) strand; PAM type: YTN; PAM sequence: CTG
ggatcaaagaatggacagtg

SEQ ID NO: 26258 - DNA, 20 bp, Artificial Sequence
  Description of Artificial Sequence: Synthetic oligonucleotide
  Target: FXN; (-) strand; PAM type: YTN; PAM sequence: TTC
cagacactgggatcaaagaa

SEQ ID NO: 26259 - DNA, 20 bp, Artificial Sequence
  Description of Artificial Sequence: Synthetic oligonucleotide
  Target: FXN; (-) strand; PAM type: YTN; PAM sequence: CTG
ttccagacactgggatcaaa

SEQ ID NO: 26260 - DNA, 20 bp, Artificial Sequence
  Description of Artificial Sequence: Synthetic oligonucleotide
  Target: FXN; (-) strand; PAM type: YTN; PAM sequence: TTG
gcactgttccagacactggg

SEQ ID NO: 26261 - DNA, 20 bp, Artificial Sequence
  Description of Artificial Sequence: Synthetic oligonucleotide
  Target: FXN; (-) strand; PAM type: YTN; PAM sequence: CTT
ggcactgttccagacactgg

SEQ ID NO: 26262 - DNA, 20 bp, Artificial Sequence
  Description of Artificial Sequence: Synthetic oligonucleotide
  Target: FXN; (-) strand; PAM type: YTN; PAM sequence: CTA
tgtacttggcactgttccag

SEQ ID NO: 26263 - DNA, 20 bp, Artificial Sequence
  Description of Artificial Sequence: Synthetic oligonucleotide
  Target: FXN; (-) strand; PAM type: YTN; PAM sequence: CTA
ctatgtacttggcactgttc

SEQ ID NO: 26264 - DNA, 20 bp, Artificial Sequence
  Description of Artificial Sequence: Synthetic oligonucleotide
  Target: FXN; (-) strand; PAM type: YTN; PAM sequence: TTA
agtccctactatgtacttgg

SEQ ID NO: 26265 - DNA, 20 bp, Artificial Sequence
  Description of Artificial Sequence: Synthetic oligonucleotide
  Target: FXN; (-) strand; PAM type: YTN; PAM sequence: TTA
ttaagtccctactatgtact

SEQ ID NO: 26266 - DNA, 20 bp, Artificial Sequence
  Description of Artificial Sequence: Synthetic oligonucleotide
  Target: FXN; (-) strand; PAM type: YTN; PAM sequence: TTT
attaagtccctactatgtac

SEQ ID NO: 26267 - DNA, 20 bp, Artificial Sequence
  Description of Artificial Sequence: Synthetic oligonucleotide
  Target: FXN; (-) strand; PAM type: YTN; PAM sequence: TTA
catatgaatcaatatttatt

SEQ ID NO: 26268 - DNA, 20 bp, Artificial Sequence
  Description of Artificial Sequence: Synthetic oligonucleotide
  Target: FXN; (-) strand; PAM type: YTN; PAM sequence: TTT
acatatgaatcaatatttat

SEQ ID NO: 26269 - DNA, 20 bp, Artificial Sequence
  Description of Artificial Sequence: Synthetic oligonucleotide
  Target: FXN; (-) strand; PAM type: YTN; PAM sequence: CTC
atttacatatgaatcaatat

SEQ ID NO: 26270 - DNA, 20 bp, Artificial Sequence
  Description of Artificial Sequence: Synthetic oligonucleotide
  Target: FXN; (-) strand; PAM type: YTN; PAM sequence: TTG
gaaaagtctcatttacatat

SEQ ID NO: 26271 - DNA, 20 bp, Artificial Sequence
  Description of Artificial Sequence: Synthetic oligonucleotide
  Target: FXN; (-) strand; PAM type: YTN; PAM sequence: TTT
ggaaaagtctcatttacata

SEQ ID NO: 26272 - DNA, 20 bp, Artificial Sequence
  Description of Artificial Sequence: Synthetic oligonucleotide
  Target: FXN; (-) strand; PAM type: YTN; PAM sequence: TTT
tggaaaagtctcatttacat

SEQ ID NO: 26273 - DNA, 20 bp, Artificial Sequence
  Description of Artificial Sequence: Synthetic oligonucleotide
  Target: FXN; (-) strand; PAM type: YTN; PAM sequence: CTG
agaggcatcaacgaaagcat

SEQ ID NO: 26274 - DNA, 20 bp, Artificial Sequence
  Description of Artificial Sequence: Synthetic oligonucleotide
  Target: FXN; (-) strand; PAM type: YTN; PAM sequence: TTG
gtaaaaggtgtataaatgct

SEQ ID NO: 26275 - DNA, 20 bp, Artificial Sequence
  Description of Artificial Sequence: Synthetic oligonucleotide
  Target: FXN; (-) strand; PAM type: YTN; PAM sequence: CTA
tgtggccagtagcgagttgg

SEQ ID NO: 26276 - DNA, 20 bp, Artificial Sequence
  Description of Artificial Sequence: Synthetic oligonucleotide
  Target: FXN; (-) strand; PAM type: YTN; PAM sequence: TTG
tctatgtggccagtagcgag

SEQ ID NO: 26277 - DNA, 20 bp, Artificial Sequence
  Description of Artificial Sequence: Synthetic oligonucleotide
  Target: FXN; (-) strand; PAM type: YTN; PAM sequence: TTT
gtctatgtggccagtagcga

SEQ ID NO: 26278 - DNA, 20 bp, Artificial Sequence
  Description of Artificial Sequence: Synthetic oligonucleotide
  Target: FXN; (-) strand; PAM type: YTN; PAM sequence: TTC
atttgtctatgtggccagta

SEQ ID NO: 26279 - DNA, 20 bp, Artificial Sequence
  Description of Artificial Sequence: Synthetic oligonucleotide
  Target: FXN; (-) strand; PAM type: YTN; PAM sequence: TTT
catttgtctatgtggccagt

SEQ ID NO: 26280 - DNA, 20 bp, Artificial Sequence
  Description of Artificial Sequence: Synthetic oligonucleotide
  Target: FXN; (-) strand; PAM type: YTN; PAM sequence: CTT
tcatttgtctatgtggccag

SEQ ID NO: 26281 - DNA, 20 bp, Artificial Sequence
  Description of Artificial Sequence: Synthetic oligonucleotide
  Target: FXN; (-) strand; PAM type: YTN; PAM sequence: CTG
ctttcatttgtctatgtggc

SEQ ID NO: 26282 - DNA, 20 bp, Artificial Sequence
  Description of Artificial Sequence: Synthetic oligonucleotide
  Target: FXN; (-) strand; PAM type: YTN; PAM sequence: TTA
ctgctttcatttgtctatgt

SEQ ID NO: 26283 - DNA, 20 bp, Artificial Sequence
  Description of Artificial Sequence: Synthetic oligonucleotide
  Target: FXN; (-) strand; PAM type: YTN; PAM sequence: CTG
gattactgctttcatttgtc

SEQ ID NO: 26284 - DNA, 20 bp, Artificial Sequence
  Description of Artificial Sequence: Synthetic oligonucleotide
  Target: FXN; (-) strand; PAM type: YTN; PAM sequence: TTG
ggtgtatctggattactgct

SEQ ID NO: 26285 - DNA, 20 bp, Artificial Sequence
  Description of Artificial Sequence: Synthetic oligonucleotide
  Target: FXN; (-) strand; PAM type: YTN; PAM sequence: CTT
gggtgtatctggattactgc

SEQ ID NO: 26286 - DNA, 20 bp, Artificial Sequence
  Description of Artificial Sequence: Synthetic oligonucleotide
  Target: FXN; (-) strand; PAM type: YTN; PAM sequence: CTC
ttgggtgtatctggattact

SEQ ID NO: 26287 - DNA, 20 bp, Artificial Sequence
  Description of Artificial Sequence: Synthetic oligonucleotide
  Target: FXN; (-) strand; PAM type: YTN; PAM sequence: CTC
cacagagagaaaaaagaaca

SEQ ID NO: 26288 - DNA, 20 bp, Artificial Sequence
  Description of Artificial Sequence: Synthetic oligonucleotide
  Target: FXN; (-) strand; PAM type: YTN; PAM sequence: CTC
ccactccacagagagaaaaa

SEQ ID NO: 26289 - DNA, 20 bp, Artificial Sequence
  Description of Artificial Sequence: Synthetic oligonucleotide
  Target: FXN; (-) strand; PAM type: YTN; PAM sequence: TTA
agtctcccactccacagaga

SEQ ID NO: 26290 - DNA, 20 bp, Artificial Sequence
  Description of Artificial Sequence: Synthetic oligonucleotide
  Target: FXN; (-) strand; PAM type: YTN; PAM sequence: CTT
aagtctcccactccacagag

SEQ ID NO: 26291 - DNA, 20 bp, Artificial Sequence
  Description of Artificial Sequence: Synthetic oligonucleotide
  Target: FXN; (-) strand; PAM type: YTN; PAM sequence: TTA
agaagccacttaagtctccc

SEQ ID NO: 26292 - DNA, 20 bp, Artificial Sequence
  Description of Artificial Sequence: Synthetic oligonucleotide
  Target: FXN; (-) strand; PAM type: YTN; PAM sequence: TTG
atcagacgacacaccagtta

SEQ ID NO: 26293 - DNA, 20 bp, Artificial Sequence
  Description of Artificial Sequence: Synthetic oligonucleotide
  Target: FXN; (-) strand; PAM type: YTN; PAM sequence: CTT
gatcagacgacacaccagtt

SEQ ID NO: 26294 - DNA, 20 bp, Artificial Sequence
  Description of Artificial Sequence: Synthetic oligonucleotide
  Target: FXN; (-) strand; PAM type: YTN; PAM sequence: CTG
gaccacttgatcagacgaca

SEQ ID NO: 26295 - DNA, 20 bp, Artificial Sequence
  Description of Artificial Sequence: Synthetic oligonucleotide
  Target: FXN; (-) strand; PAM type: YTN; PAM sequence: TTA
cctggaccacttgatcagac

SEQ ID NO: 26296 - DNA, 20 bp, Artificial Sequence
  Description of Artificial Sequence: Synthetic oligonucleotide
  Target: FXN; (-) strand; PAM type: YTN; PAM sequence: CTG
ttacctggaccacttgatca

SEQ ID NO: 26297 - DNA, 20 bp, Artificial Sequence
  Description of Artificial Sequence: Synthetic oligonucleotide
  Target: FXN; (-) strand; PAM type: YTN; PAM sequence: TTG
gcatccacctgttacctgga

SEQ ID NO: 26298 - DNA, 20 bp, Artificial Sequence
  Description of Artificial Sequence: Synthetic oligonucleotide
  Target: FXN; (-) strand; PAM type: YTN; PAM sequence: CTG
ggccagacattggcatccac

SEQ ID NO: 26299 - DNA, 20 bp, Artificial Sequence
  Description of Artificial Sequence: Synthetic oligonucleotide
  Target: FXN; (-) strand; PAM type: YTN; PAM sequence: CTG
taatgaccagtgccagtaag

SEQ ID NO: 26300 - DNA, 20 bp, Artificial Sequence
  Description of Artificial Sequence: Synthetic oligonucleotide
  Target: FXN; (-) strand; PAM type: YTN; PAM sequence: TTC
tgtaatgaccagtgccagta

SEQ ID NO: 26301 - DNA, 20 bp, Artificial Sequence
  Description of Artificial Sequence: Synthetic oligonucleotide
  Target: FXN; (-) strand; PAM type: YTN; PAM sequence: CTT
ctgtaatgaccagtgccagt

SEQ ID NO: 26302 - DNA, 20 bp, Artificial Sequence
  Description of Artificial Sequence: Synthetic oligonucleotide
  Target: FXN; (-) strand; PAM type: YTN; PAM sequence: CTG
gtagagtgtcttctgtaatg

SEQ ID NO: 26303 - DNA, 20 bp, Artificial Sequence
  Description of Artificial Sequence: Synthetic oligonucleotide
  Target: FXN; (-) strand; PAM type: YTN; PAM sequence: CTC
tggtagagtgtcttctgtaa

SEQ ID NO: 26304 - DNA, 20 bp, Artificial Sequence
  Description of Artificial Sequence: Synthetic oligonucleotide
  Target: FXN; (-) strand; PAM type: YTN; PAM sequence: TTC
agctctggtagagtgtcttc

SEQ ID NO: 26305 - DNA, 20 bp, Artificial Sequence
  Description of Artificial Sequence: Synthetic oligonucleotide
  Target: FXN; (-) strand; PAM type: YTN; PAM sequence: TTT
cagctctggtagagtgtctt

SEQ ID NO: 26306 - DNA, 20 bp, Artificial Sequence
  Description of Artificial Sequence: Synthetic oligonucleotide
  Target: FXN; (-) strand; PAM type: YTN; PAM sequence: CTT
tcagctctggtagagtgtct

SEQ ID NO: 26307 - DNA, 20 bp, Artificial Sequence
  Description of Artificial Sequence: Synthetic oligonucleotide
  Target: FXN; (-) strand; PAM type: YTN; PAM sequence: CTA
gtgacaagaggtcctttcag

SEQ ID NO: 26308 - DNA, 20 bp, Artificial Sequence
  Description of Artificial Sequence: Synthetic oligonucleotide
  Target: FXN; (-) strand; PAM type: YTN; PAM sequence: CTG
cctagtgacaagaggtcctt

SEQ ID NO: 26309 - DNA, 20 bp, Artificial Sequence
  Description of Artificial Sequence: Synthetic oligonucleotide
  Target: FXN; (-) strand; PAM type: YTN; PAM sequence: CTC
cacagctgcctagtgacaag

SEQ ID NO: 26310 - DNA, 20 bp, Artificial Sequence
  Description of Artificial Sequence: Synthetic oligonucleotide
  Target: FXN; (-) strand; PAM type: YTN; PAM sequence: CTA
ggtcaagtagagcggactcc

SEQ ID NO: 26311 - DNA, 20 bp, Artificial Sequence
  Description of Artificial Sequence: Synthetic oligonucleotide
  Target: FXN; (-) strand; PAM type: YTN; PAM sequence: TTA
ctaggtcaagtagagcggac

SEQ ID NO: 26312 - DNA, 20 bp, Artificial Sequence
  Description of Artificial Sequence: Synthetic oligonucleotide
  Target: FXN; (-) strand; PAM type: YTN; PAM sequence: TTT
actaggtcaagtagagcgga

SEQ ID NO: 26313 - DNA, 20 bp, Artificial Sequence
  Description of Artificial Sequence: Synthetic oligonucleotide
  Target: FXN; (-) strand; PAM type: YTN; PAM sequence: TTT
tactaggtcaagtagagcgg

SEQ ID NO: 26314 - DNA, 20 bp, Artificial Sequence
  Description of Artificial Sequence: Synthetic oligonucleotide
  Target: FXN; (-) strand; PAM type: YTN; PAM sequence: CTC
caggcagattttactaggtc

SEQ ID NO: 26315 - DNA, 20 bp, Artificial Sequence
  Description of Artificial Sequence: Synthetic oligonucleotide
  Target: FXN; (-) strand; PAM type: YTN; PAM sequence: CTA
acagtctccaggcagatttt

SEQ ID NO: 26316 - DNA, 20 bp, Artificial Sequence
  Description of Artificial Sequence: Synthetic oligonucleotide
  Target: FXN; (-) strand; PAM type: YTN; PAM sequence: CTC
taacagtctccaggcagatt

SEQ ID NO: 26317 - DNA, 20 bp, Artificial Sequence
  Description of Artificial Sequence: Synthetic oligonucleotide
  Target: FXN; (-) strand; PAM type: YTN; PAM sequence: TTC
aggtagtggggtgactctaa

SEQ ID NO: 26318 - DNA, 20 bp, Artificial Sequence
  Description of Artificial Sequence: Synthetic oligonucleotide
  Target: FXN; (-) strand; PAM type: YTN; PAM sequence: CTT
caggtagtggggtgactcta

SEQ ID NO: 26319 - DNA, 20 bp, Artificial Sequence
  Description of Artificial Sequence: Synthetic oligonucleotide
  Target: FXN; (-) strand; PAM type: YTN; PAM sequence: CTG
gaggtaacttcaggtagtgg

SEQ ID NO: 26320 - DNA, 20 bp, Artificial Sequence
  Description of Artificial Sequence: Synthetic oligonucleotide
  Target: FXN; (-) strand; PAM type: YTN; PAM sequence: CTG
ggaaaaaaaagaggtcagcc

SEQ ID NO: 26321 - DNA, 20 bp, Artificial Sequence
  Description of Artificial Sequence: Synthetic oligonucleotide
  Target: FXN; (-) strand; PAM type: YTN; PAM sequence: CTC
cacctgggaaaaaaaagagg

SEQ ID NO: 26322 - DNA, 20 bp, Artificial Sequence
  Description of Artificial Sequence: Synthetic oligonucleotide
  Target: FXN; (-) strand; PAM type: YTN; PAM sequence: CTA
agatgccaggactccacctg

SEQ ID NO: 26323 - DNA, 20 bp, Artificial Sequence
  Description of Artificial Sequence: Synthetic oligonucleotide
  Target: FXN; (-) strand; PAM type: YTN; PAM sequence: TTA
aaatatctaagatgccagga

SEQ ID NO: 26324 - DNA, 20 bp, Artificial Sequence
  Description of Artificial Sequence: Synthetic oligonucleotide
  Target: FXN; (-) strand; PAM type: YTN; PAM sequence: TTA
ttaaaatatctaagatgcca

SEQ ID NO: 26325 - DNA, 20 bp, Artificial Sequence
  Description of Artificial Sequence: Synthetic oligonucleotide
  Target: FXN; (-) strand; PAM type: YTN; PAM sequence: CTT
attaaaatatctaagatgcc

SEQ ID NO: 26326 - DNA, 20 bp, Artificial Sequence
  Description of Artificial Sequence: Synthetic oligonucleotide
  Target: FXN; (-) strand; PAM type: YTN; PAM sequence: TTA
gtgaataaagaacatgtcaa

SEQ ID NO: 26327 - DNA, 20 bp, Artificial Sequence
  Description of Artificial Sequence: Synthetic oligonucleotide
  Target: FXN; (-) strand; PAM type: YTN; PAM sequence: CTT
agtgaataaagaacatgtca

SEQ ID NO: 26328 - DNA, 20 bp, Artificial Sequence
  Description of Artificial Sequence: Synthetic oligonucleotide
  Target: FXN; (-) strand; PAM type: YTN; PAM sequence: CTG
acaccttagtgaataaagaa

SEQ ID NO: 26329 - DNA, 20 bp, Artificial Sequence
  Description of Artificial Sequence: Synthetic oligonucleotide
  Target: FXN; (-) strand; PAM type: YTN; PAM sequence: CTA
agacagtaatatgctgacac

SEQ ID NO: 26330 - DNA, 20 bp, Artificial Sequence
  Description of Artificial Sequence: Synthetic oligonucleotide
  Target: FXN; (-) strand; PAM type: YTN; PAM sequence: TTC
taagacagtaatatgctgac

SEQ ID NO: 26331 - DNA, 20 bp, Artificial Sequence
  Description of Artificial Sequence: Synthetic oligonucleotide
  Target: FXN; (-) strand; PAM type: YTN; PAM sequence: CTC
agttctaagacagtaatatg

SEQ ID NO: 26332 - DNA, 20 bp, Artificial Sequence
  Description of Artificial Sequence: Synthetic oligonucleotide
  Target: FXN; (-) strand; PAM type: YTN; PAM sequence: CTG
atccaaaaaagatgaagaac

SEQ ID NO: 26333 - DNA, 20 bp, Artificial Sequence
  Description of Artificial Sequence: Synthetic oligonucleotide
  Target: FXN; (-) strand; PAM type: YTN; PAM sequence: TTA
gagggaggtcctgatccaaa

SEQ ID NO: 26334 - DNA, 20 bp, Artificial Sequence
  Description of Artificial Sequence: Synthetic oligonucleotide
  Target: FXN; (-) strand; PAM type: YTN; PAM sequence: CTT
agagggaggtcctgatccaa

SEQ ID NO: 26335 - DNA, 20 bp, Artificial Sequence
  Description of Artificial Sequence: Synthetic oligonucleotide
  Target: FXN; (-) strand; PAM type: YTN; PAM sequence: TTC
ttagagggaggtcctgatcc

SEQ ID NO: 26336 - DNA, 20 bp, Artificial Sequence
  Description of Artificial Sequence: Synthetic oligonucleotide
  Target: FXN; (-) strand; PAM type: YTN; PAM sequence: TTG
ggagagggaccagagcagtc

SEQ ID NO: 26337 - DNA, 20 bp, Artificial Sequence
  Description of Artificial Sequence: Synthetic oligonucleotide
  Target: FXN; (-) strand; PAM type: YTN; PAM sequence: TTA
ttgggagagggaccagagca

SEQ ID NO: 26338 - DNA, 20 bp, Artificial Sequence
  Description of Artificial Sequence: Synthetic oligonucleotide
  Target: FXN; (-) strand; PAM type: YTN; PAM sequence: TTT
attgggagagggaccagagc

SEQ ID NO: 26339 - DNA, 20 bp, Artificial Sequence
  Description of Artificial Sequence: Synthetic oligonucleotide
  Target: FXN; (-) strand; PAM type: YTN; PAM sequence: TTT
tattgggagagggaccagag

SEQ ID NO: 26340 - DNA, 20 bp, Artificial Sequence
  Description of Artificial Sequence: Synthetic oligonucleotide
  Target: FXN; (-) strand; PAM type: YTN; PAM sequence: TTT
ttattgggagagggaccaga

SEQ ID NO: 26341 - DNA, 20 bp, Artificial Sequence
  Description of Artificial Sequence: Synthetic oligonucleotide
  Target: FXN; (-) strand; PAM type: YTN; PAM sequence: TTA
acaggtgagtatggaagttt

SEQ ID NO: 26342 - DNA, 20 bp, Artificial Sequence
  Description of Artificial Sequence: Synthetic oligonucleotide
  Target: FXN; (-) strand; PAM type: YTN; PAM sequence: TTT
aacaggtgagtatggaagtt

SEQ ID NO: 26343 - DNA, 20 bp, Artificial Sequence
  Description of Artificial Sequence: Synthetic oligonucleotide
  Target: FXN; (-) strand; PAM type: YTN; PAM sequence: TTT
taacaggtgagtatggaagt

SEQ ID NO: 26344 - DNA, 20 bp, Artificial Sequence
  Description of Artificial Sequence: Synthetic oligonucleotide
  Target: FXN; (-) strand; PAM type: YTN; PAM sequence: TTT
ttaacaggtgagtatggaag

SEQ ID NO: 26345 - DNA, 20 bp, Artificial Sequence
  Description of Artificial Sequence: Synthetic oligonucleotide
  Target: FXN; (-) strand; PAM type: YTN; PAM sequence: TTT
tttaacaggtgagtatggaa

SEQ ID NO: 26346 - DNA, 20 bp, Artificial Sequence
  Description of Artificial Sequence: Synthetic oligonucleotide
  Target: FXN; (-) strand; PAM type: YTN; PAM sequence: TTT
ttttaacaggtgagtatgga

SEQ ID NO: 26347 - DNA, 20 bp, Artificial Sequence
  Description of Artificial Sequence: Synthetic oligonucleotide
  Target: FXN; (-) strand; PAM type: YTN; PAM sequence: TTT
tttttaacaggtgagtatgg

SEQ ID NO: 26348 - DNA, 20 bp, Artificial Sequence
  Description of Artificial Sequence: Synthetic oligonucleotide
  Target: FXN; (-) strand; PAM type: YTN; PAM sequence: TTT
ttttttaacaggtgagtatg

SEQ ID NO: 26349 - DNA, 20 bp, Artificial Sequence
  Description of Artificial Sequence: Synthetic oligonucleotide
  Target: FXN; (-) strand; PAM type: YTN; PAM sequence: TTT
tttttttaacaggtgagtat

SEQ ID NO: 26350 - DNA, 20 bp, Artificial Sequence
  Description of Artificial Sequence: Synthetic oligonucleotide
  Target: FXN; (-) strand; PAM type: YTN; PAM sequence: TTT
ttttttttaacaggtgagta

SEQ ID NO: 26351 - DNA, 20 bp, Artificial Sequence
  Description of Artificial Sequence: Synthetic oligonucleotide
  Target: FXN; (-) strand; PAM type: YTN; PAM sequence: TTT
tttttttttaacaggtgagt

SEQ ID NO: 26352 - DNA, 20 bp, Artificial Sequence
  Description of Artificial Sequence: Synthetic oligonucleotide
  Target: FXN; (-) strand; PAM type: YTN; PAM sequence: TTT
ttttttttttaacaggtgag

SEQ ID NO: 26353 - DNA, 20 bp, Artificial Sequence
  Description of Artificial Sequence: Synthetic oligonucleotide
  Target: FXN; (-) strand; PAM type: YTN; PAM sequence: TTT
tttttttttttaacaggtga

SEQ ID NO: 26354 - DNA, 20 bp, Artificial Sequence
  Description of Artificial Sequence: Synthetic oligonucleotide
  Target: FXN; (-) strand; PAM type: YTN; PAM sequence: TTA
aagttttttttttttttaac

SEQ ID NO: 26355 - DNA, 20 bp, Artificial Sequence
  Description of Artificial Sequence: Synthetic oligonucleotide
  Target: FXN; (-) strand; PAM type: YTN; PAM sequence: TTT
aaagttttttttttttttaa

SEQ ID NO: 26356 - DNA, 20 bp, Artificial Sequence
  Description of Artificial Sequence: Synthetic oligonucleotide
  Target: FXN; (-) strand; PAM type: YTN; PAM sequence: TTG
tttaaagttttttttttttt

SEQ ID NO: 26357 - DNA, 20 bp, Artificial Sequence
  Description of Artificial Sequence: Synthetic oligonucleotide
  Target: FXN; (-) strand; PAM type: YTN; PAM sequence: TTT
gtttaaagtttttttttttt

SEQ ID NO: 26358 - DNA, 20 bp, Artificial Sequence
  Description of Artificial Sequence: Synthetic oligonucleotide
  Target: FXN; (-) strand; PAM type: YTN; PAM sequence: TTA
atttgtttaaagtttttttt

SEQ ID NO: 26359 - DNA, 20 bp, Artificial Sequence
  Description of Artificial Sequence: Synthetic oligonucleotide
  Target: FXN; (-) strand; PAM type: YTN; PAM sequence: CTG
ttaatttgtttaaagttttt

SEQ ID NO: 26360 - DNA, 20 bp, Artificial Sequence
  Description of Artificial Sequence: Synthetic oligonucleotide
  Target: FXN; (-) strand; PAM type: YTN; PAM sequence: CTC
tgttaatttgtttaaagttt

SEQ ID NO: 26361 - DNA, 20 bp, Artificial Sequence
  Description of Artificial Sequence: Synthetic oligonucleotide
  Target: FXN; (-) strand; PAM type: YTN; PAM sequence: CTG
aataaaactctgttaatttg

SEQ ID NO: 26362 - DNA, 20 bp, Artificial Sequence
  Description of Artificial Sequence: Synthetic oligonucleotide
  Target: FXN; (-) strand; PAM type: YTN; PAM sequence: TTG
ctgaataaaactctgttaat

SEQ ID NO: 26363 - DNA, 20 bp, Artificial Sequence
  Description of Artificial Sequence: Synthetic oligonucleotide
  Target: FXN; (-) strand; PAM type: YTN; PAM sequence: TTT
gctgaataaaactctgttaa

SEQ ID NO: 26364 - DNA, 20 bp, Artificial Sequence
  Description of Artificial Sequence: Synthetic oligonucleotide
  Target: FXN; (-) strand; PAM type: YTN; PAM sequence: CTT
tgctgaataaaactctgtta

SEQ ID NO: 26365 - DNA, 20 bp, Artificial Sequence
  Description of Artificial Sequence: Synthetic oligonucleotide
  Target: FXN; (-) strand; PAM type: YTN; PAM sequence: TTC
tttgctgaataaaactctgt

SEQ ID NO: 26366 - DNA, 20 bp, Artificial Sequence
  Description of Artificial Sequence: Synthetic oligonucleotide
  Target: FXN; (-) strand; PAM type: YTN; PAM sequence: TTA
tgaatcattctttgctgaat

SEQ ID NO: 26367 - DNA, 20 bp, Artificial Sequence
  Description of Artificial Sequence: Synthetic oligonucleotide
  Target: FXN; (-) strand; PAM type: YTN; PAM sequence: TTT
atgaatcattctttgctgaa

SEQ ID NO: 26368 - DNA, 20 bp, Artificial Sequence
  Description of Artificial Sequence: Synthetic oligonucleotide
  Target: FXN; (-) strand; PAM type: YTN; PAM sequence: TTC
ccgatttatgaatcattctt

SEQ ID NO: 26369 - DNA, 20 bp, Artificial Sequence
  Description of Artificial Sequence: Synthetic oligonucleotide
  Target: FXN; (-) strand; PAM type: YTN; PAM sequence: CTT
cccgatttatgaatcattct

SEQ ID NO: 26370 - DNA, 20 bp, Artificial Sequence
  Description of Artificial Sequence: Synthetic oligonucleotide
  Target: FXN; (-) strand; PAM type: YTN; PAM sequence: TTG
cagccttcccgatttatgaa

SEQ ID NO: 26371 - DNA, 20 bp, Artificial Sequence
  Description of Artificial Sequence: Synthetic oligonucleotide
  Target: FXN; (-) strand; PAM type: YTN; PAM sequence: CTG
gttgcagccttcccgattta

SEQ ID NO: 26372 - DNA, 20 bp, Artificial Sequence
  Description of Artificial Sequence: Synthetic oligonucleotide
  Target: FXN; (-) strand; PAM type: YTN; PAM sequence: TTC
tggttgcagccttcccgatt

SEQ ID NO: 26373 - DNA, 20 bp, Artificial Sequence
  Description of Artificial Sequence: Synthetic oligonucleotide
  Target: FXN; (-) strand; PAM type: YTN; PAM sequence: CTA
ttctggttgcagccttcccg

SEQ ID NO: 26374 - DNA, 20 bp, Artificial Sequence
  Description of Artificial Sequence: Synthetic oligonucleotide
  Target: FXN; (-) strand; PAM type: YTN; PAM sequence: CTG
aacctattctggttgcagcc

SEQ ID NO: 26375 - DNA, 20 bp, Artificial Sequence
  Description of Artificial Sequence: Synthetic oligonucleotide
  Target: FXN; (-) strand; PAM type: YTN; PAM sequence: CTC
tgaacctattctggttgcag

SEQ ID NO: 26376 - DNA, 20 bp, Artificial Sequence
  Description of Artificial Sequence: Synthetic oligonucleotide
  Target: FXN; (-) strand; PAM type: YTN; PAM sequence: CTC
tctgaacctattctggttgc

SEQ ID NO: 26377 - DNA, 20 bp, Artificial Sequence
  Description of Artificial Sequence: Synthetic oligonucleotide
  Target: FXN; (-) strand; PAM type: YTN; PAM sequence: CTC
caaccacgtggcacaccgtg

SEQ ID NO: 26378 - DNA, 20 bp, Artificial Sequence
  Description of Artificial Sequence: Synthetic oligonucleotide
  Target: FXN; (-) strand; PAM type: YTN; PAM sequence: CTC
tccaaccacgtggcacaccg

SEQ ID NO: 26379 - DNA, 20 bp, Artificial Sequence
  Description of Artificial Sequence: Synthetic oligonucleotide
  Target: FXN; (-) strand; PAM type: YTN; PAM sequence: CTA
aatcctctccaaccacgtgg

SEQ ID NO: 26380 - DNA, 20 bp, Artificial Sequence
  Description of Artificial Sequence: Synthetic oligonucleotide
  Target: FXN; (-) strand; PAM type: YTN; PAM sequence: CTG
tgcataaatcctaaatcctc

SEQ ID NO: 26381 - DNA, 20 bp, Artificial Sequence
  Description of Artificial Sequence: Synthetic oligonucleotide
  Target: FXN; (-) strand; PAM type: YTN; PAM sequence: TTC
tgtgcataaatcctaaatcc

SEQ ID NO: 26382 - DNA, 20 bp, Artificial Sequence
  Description of Artificial Sequence: Synthetic oligonucleotide
  Target: FXN; (-) strand; PAM type: YTN; PAM sequence: TTT
ctgtgcataaatcctaaatc

SEQ ID NO: 26383 - DNA, 20 bp, Artificial Sequence
  Description of Artificial Sequence: Synthetic oligonucleotide
  Target: FXN; (-) strand; PAM type: YTN; PAM sequence: TTT
tctgtgcataaatcctaaat

SEQ ID NO: 26384 - DNA, 20 bp, Artificial Sequence
  Description of Artificial Sequence: Synthetic oligonucleotide
  Target: FXN; (-) strand; PAM type: YTN; PAM sequence: TTT
ttctgtgcataaatcctaaa

SEQ ID NO: 26385 - DNA, 20 bp, Artificial Sequence
  Description of Artificial Sequence: Synthetic oligonucleotide
  Target: FXN; (-) strand; PAM type: YTN; PAM sequence: CTT
tttctgtgcataaatcctaa

SEQ ID NO: 26386 - DNA, 20 bp, Artificial Sequence
  Description of Artificial Sequence: Synthetic oligonucleotide
  Target: FXN; (-) strand; PAM type: YTN; PAM sequence: TTC
ctttttctgtgcataaatcc

SEQ ID NO: 26387 - DNA, 20 bp, Artificial Sequence
  Description of Artificial Sequence: Synthetic oligonucleotide
  Target: FXN; (-) strand; PAM type: YTN; PAM sequence: TTT
cctttttctgtgcataaatc

SEQ ID NO: 26388 - DNA, 20 bp, Artificial Sequence
  Description of Artificial Sequence: Synthetic oligonucleotide
  Target: FXN; (-) strand; PAM type: YTN; PAM sequence: CTT
tcctttttctgtgcataaat

SEQ ID NO: 26389 - DNA, 20 bp, Artificial Sequence
  Description of Artificial Sequence: Synthetic oligonucleotide
  Target: FXN; (-) strand; PAM type: YTN; PAM sequence: CTG
catgtcactttcctttttct

SEQ ID NO: 26390 - DNA, 20 bp, Artificial Sequence
  Description of Artificial Sequence: Synthetic oligonucleotide
  Target: FXN; (-) strand; PAM type: YTN; PAM sequence: TTC
tgcatgtcactttccttttt

SEQ ID NO: 26391 - DNA, 20 bp, Artificial Sequence
  Description of Artificial Sequence: Synthetic oligonucleotide
  Target: FXN; (-) strand; PAM type: YTN; PAM sequence: TTT
ctgcatgtcactttcctttt

SEQ ID NO: 26392 - DNA, 20 bp, Artificial Sequence
  Description of Artificial Sequence: Synthetic oligonucleotide
  Target: FXN; (-) strand; PAM type: YTN; PAM sequence: TTT
tctgcatgtcactttccttt

SEQ ID NO: 26393 - DNA, 20 bp, Artificial Sequence
  Description of Artificial Sequence: Synthetic oligonucleotide
  Target: FXN; (-) strand; PAM type: YTN; PAM sequence: TTC
attttctgcatgtcactttc

SEQ ID NO: 26394 - DNA, 20 bp, Artificial Sequence
  Description of Artificial Sequence: Synthetic oligonucleotide
  Target: FXN; (-) strand; PAM type: YTN; PAM sequence: TTT
cattttctgcatgtcacttt

SEQ ID NO: 26395 - DNA, 20 bp, Artificial Sequence
  Description of Artificial Sequence: Synthetic oligonucleotide
  Target: FXN; (-) strand; PAM type: YTN; PAM sequence: CTT
tcattttctgcatgtcactt

SEQ ID NO: 26396 - DNA, 20 bp, Artificial Sequence
  Description of Artificial Sequence: Synthetic oligonucleotide
  Target: FXN; (-) strand; PAM type: YTN; PAM sequence: CTC
actttcattttctgcatgtc

SEQ ID NO: 26397 - DNA, 20 bp, Artificial Sequence
  Description of Artificial Sequence: Synthetic oligonucleotide
  Target: FXN; (-) strand; PAM type: YTN; PAM sequence: TTA
caggcgtgaggcaccgcacc

SEQ ID NO: 26398 - DNA, 20 bp, Artificial Sequence
  Description of Artificial Sequence: Synthetic oligonucleotide
  Target: FXN; (-) strand; PAM type: YTN; PAM sequence: CTG
ggattacaggcgtgaggcac

SEQ ID NO: 26399 - DNA, 20 bp, Artificial Sequence
  Description of Artificial Sequence: Synthetic oligonucleotide
  Target: FXN; (-) strand; PAM type: YTN; PAM sequence: CTC
ccaaagtgctgggattacag

SEQ ID NO: 26400 - DNA, 20 bp, Artificial Sequence
  Description of Artificial Sequence: Synthetic oligonucleotide
  Target: FXN; (-) strand; PAM type: YTN; PAM sequence: CTC
ggcctcccaaagtgctggga

SEQ ID NO: 26401 - DNA, 20 bp, Artificial Sequence
  Description of Artificial Sequence: Synthetic oligonucleotide
  Target: FXN; (-) strand; PAM type: YTN; PAM sequence: CTG
cccgcctcggcctcccaaag

SEQ ID NO: 26402 - DNA, 20 bp, Artificial Sequence
  Description of Artificial Sequence: Synthetic oligonucleotide
  Target: FXN; (-) strand; PAM type: YTN; PAM sequence: CTC
atgatctgcccgcctcggcc

SEQ ID NO: 26403 - DNA, 20 bp, Artificial Sequence
  Description of Artificial Sequence: Synthetic oligonucleotide
  Target: FXN; (-) strand; PAM type: YTN; PAM sequence: CTG
acctcatgatctgcccgcct

SEQ ID NO: 26404 - DNA, 20 bp, Artificial Sequence
  Description of Artificial Sequence: Synthetic oligonucleotide
  Target: FXN; (-) strand; PAM type: YTN; PAM sequence: CTC
ctgacctcatgatctgcccg

SEQ ID NO: 26405 - DNA, 20 bp, Artificial Sequence
  Description of Artificial Sequence: Synthetic oligonucleotide
  Target: FXN; (-) strand; PAM type: YTN; PAM sequence: CTC
gatctcctgacctcatgatc

SEQ ID NO: 26406 - DNA, 20 bp, Artificial Sequence
  Description of Artificial Sequence: Synthetic oligonucleotide
  Target: FXN; (-) strand; PAM type: YTN; PAM sequence: TTA
gccaggatggtctcgatctc

SEQ ID NO: 26407 - DNA, 20 bp, Artificial Sequence
  Description of Artificial Sequence: Synthetic oligonucleotide
  Target: FXN; (-) strand; PAM type: YTN; PAM sequence: TTC
accgtgttagccaggatggt

SEQ ID NO: 26408 - DNA, 20 bp, Artificial Sequence
  Description of Artificial Sequence: Synthetic oligonucleotide
  Target: FXN; (-) strand; PAM type: YTN; PAM sequence: TTT
caccgtgttagccaggatgg

SEQ ID NO: 26409 - DNA, 20 bp, Artificial Sequence
  Description of Artificial Sequence: Synthetic oligonucleotide
  Target: FXN; (-) strand; PAM type: YTN; PAM sequence: TTA
gtagagacagggtttcaccg

SEQ ID NO: 26410 - DNA, 20 bp, Artificial Sequence
  Description of Artificial Sequence: Synthetic oligonucleotide
  Target: FXN; (-) strand; PAM type: YTN; PAM sequence: TTT
agtagagacagggtttcacc

SEQ ID NO: 26411 - DNA, 20 bp, Artificial Sequence
  Description of Artificial Sequence: Synthetic oligonucleotide
  Target: FXN; (-) strand; PAM type: YTN; PAM sequence: TTT
tagtagagacagggtttcac

SEQ ID NO: 26412 - DNA, 20 bp, Artificial Sequence
  Description of Artificial Sequence: Synthetic oligonucleotide
  Target: FXN; (-) strand; PAM type: YTN; PAM sequence: TTT
ttagtagagacagggtttca

SEQ ID NO: 26413 - DNA, 20 bp, Artificial Sequence
  Description of Artificial Sequence: Synthetic oligonucleotide
  Target: FXN; (-) strand; PAM type: YTN; PAM sequence: TTG
catttttagtagagacaggg

SEQ ID NO: 26414 - DNA, 20 bp, Artificial Sequence
  Description of Artificial Sequence: Synthetic oligonucleotide
  Target: FXN; (-) strand; PAM type: YTN; PAM sequence: TTT
gcatttttagtagagacagg

SEQ ID NO: 26415 - DNA, 20 bp, Artificial Sequence
  Description of Artificial Sequence: Synthetic oligonucleotide
  Target: FXN; (-) strand; PAM type: YTN; PAM sequence: TTT
tgcatttttagtagagacag

SEQ ID NO: 26416 - DNA, 20 bp, Artificial Sequence
  Description of Artificial Sequence: Synthetic oligonucleotide
  Target: FXN; (-) strand; PAM type: YTN; PAM sequence: TTT
ttgcatttttagtagagaca

SEQ ID NO: 26417 - DNA, 20 bp, Artificial Sequence
  Description of Artificial Sequence: Synthetic oligonucleotide
  Target: FXN; (-) strand; PAM type: YTN; PAM sequence: CTA
agtttttgcatttttagtag

SEQ ID NO: 26418 - DNA, 20 bp, Artificial Sequence
  Description of Artificial Sequence: Synthetic oligonucleotide
  Target: FXN; (-) strand; PAM type: YTN; PAM sequence: CTG
ccaccacgcccggctaagtt

SEQ ID NO: 26419 - DNA, 20 bp, Artificial Sequence
  Description of Artificial Sequence: Synthetic oligonucleotide
  Target: FXN; (-) strand; PAM type: YTN; PAM sequence: CTA
caggtgcctgccaccacgcc

SEQ ID NO: 26420 - DNA, 20 bp, Artificial Sequence
  Description of Artificial Sequence: Synthetic oligonucleotide
  Target: FXN; (-) strand; PAM type: YTN; PAM sequence: CTG
ggactacaggtgcctgccac

SEQ ID NO: 26421 - DNA, 20 bp, Artificial Sequence
  Description of Artificial Sequence: Synthetic oligonucleotide
  Target: FXN; (-) strand; PAM type: YTN; PAM sequence: CTC
ccaagtagctgggactacag

SEQ ID NO: 26422 - DNA, 20 bp, Artificial Sequence
  Description of Artificial Sequence: Synthetic oligonucleotide
  Target: FXN; (-) strand; PAM type: YTN; PAM sequence: CTC
agcctcccaagtagctggga

SEQ ID NO: 26423 - DNA, 20 bp, Artificial Sequence
  Description of Artificial Sequence: Synthetic oligonucleotide
  Target: FXN; (-) strand; PAM type: YTN; PAM sequence: CTG
cctcagcctcccaagtagct

SEQ ID NO: 26424 - DNA, 20 bp, Artificial Sequence
  Description of Artificial Sequence: Synthetic oligonucleotide
  Target: FXN; (-) strand; PAM type: YTN; PAM sequence: CTC
ctgcctcagcctcccaagta

SEQ ID NO: 26425 - DNA, 20 bp, Artificial Sequence
  Description of Artificial Sequence: Synthetic oligonucleotide
  Target: FXN; (-) strand; PAM type: YTN; PAM sequence: TTC
tcctgcctcagcctcccaag

SEQ ID NO: 26426 - DNA, 20 bp, Artificial Sequence
  Description of Artificial Sequence: Synthetic oligonucleotide
  Target: FXN; (-) strand; PAM type: YTN; PAM sequence: TTC
acaccattctcctgcctcag

SEQ ID NO: 26427 - DNA, 20 bp, Artificial Sequence
  Description of Artificial Sequence: Synthetic oligonucleotide
  Target: FXN; (-) strand; PAM type: YTN; PAM sequence: CTC
ccaggttcacaccattctcc

SEQ ID NO: 26428 - DNA, 20 bp, Artificial Sequence
  Description of Artificial Sequence: Synthetic oligonucleotide
  Target: FXN; (-) strand; PAM type: YTN; PAM sequence: CTC
cgcctcccaggttcacacca

SEQ ID NO: 26429 - DNA, 20 bp, Artificial Sequence
  Description of Artificial Sequence: Synthetic oligonucleotide
  Target: FXN; (-) strand; PAM type: YTN; PAM sequence: CTG
caagctccgcctcccaggtt

SEQ ID NO: 26430 - DNA, 20 bp, Artificial Sequence
  Description of Artificial Sequence: Synthetic oligonucleotide
  Target: FXN; (-) strand; PAM type: YTN; PAM sequence: CTC
actgcaagctccgcctccca

SEQ ID NO: 26431 - DNA, 20 bp, Artificial Sequence
  Description of Artificial Sequence: Synthetic oligonucleotide
  Target: FXN; (-) strand; PAM type: YTN; PAM sequence: CTG
gctcactgcaagctccgcct

SEQ ID NO: 26432 - DNA, 20 bp, Artificial Sequence
  Description of Artificial Sequence: Synthetic oligonucleotide
  Target: FXN; (-) strand; PAM type: YTN; PAM sequence: CTG
gagtgcagtggcgggatcct

SEQ ID NO: 26433 - DNA, 20 bp, Artificial Sequence
  Description of Artificial Sequence: Synthetic oligonucleotide
  Target: FXN; (-) strand; PAM type: YTN; PAM sequence: CTG
tcgcccaggctggagtgcag

SEQ ID NO: 26434 - DNA, 20 bp, Artificial Sequence
  Description of Artificial Sequence: Synthetic oligonucleotide
  Target: FXN; (-) strand; PAM type: YTN; PAM sequence: CTC
tgtcgcccaggctggagtgc

SEQ ID NO: 26435 - DNA, 20 bp, Artificial Sequence
  Description of Artificial Sequence: Synthetic oligonucleotide
  Target: FXN; (-) strand; PAM type: YTN; PAM sequence: CTC
gctctgtcgcccaggctgga

SEQ ID NO: 26436 - DNA, 20 bp, Artificial Sequence
  Description of Artificial Sequence: Synthetic oligonucleotide
  Target: FXN; (-) strand; PAM type: YTN; PAM sequence: TTA
agatgaagtctcgctctgtc

SEQ ID NO: 26437 - DNA, 20 bp, Artificial Sequence
  Description of Artificial Sequence: Synthetic oligonucleotide
  Target: FXN; (-) strand; PAM type: YTN; PAM sequence: TTT
aagatgaagtctcgctctgt

SEQ ID NO: 26438 - DNA, 20 bp, Artificial Sequence
  Description of Artificial Sequence: Synthetic oligonucleotide
  Target: FXN; (-) strand; PAM type: YTN; PAM sequence: TTT
taagatgaagtctcgctctg

SEQ ID NO: 26439 - DNA, 20 bp, Artificial Sequence
  Description of Artificial Sequence: Synthetic oligonucleotide
  Target: FXN; (-) strand; PAM type: YTN; PAM sequence: TTT
ttaagatgaagtctcgctct

SEQ ID NO: 26440 - DNA, 20 bp, Artificial Sequence
  Description of Artificial Sequence: Synthetic oligonucleotide
  Target: FXN; (-) strand; PAM type: YTN; PAM sequence: TTT
tttaagatgaagtctcgctc

SEQ ID NO: 26441 - DNA, 20 bp, Artificial Sequence
  Description of Artificial Sequence: Synthetic oligonucleotide
  Target: FXN; (-) strand; PAM type: YTN; PAM sequence: TTT
ttttaagatgaagtctcgct

SEQ ID NO: 26442 - DNA, 20 bp, Artificial Sequence
  Description of Artificial Sequence: Synthetic oligonucleotide
  Target: FXN; (-) strand; PAM type: YTN; PAM sequence: TTT
tttttaagatgaagtctcgc

SEQ ID NO: 26443 - DNA, 20 bp, Artificial Sequence
  Description of Artificial Sequence: Synthetic oligonucleotide
  Target: FXN; (-) strand; PAM type: YTN; PAM sequence: TTT
ttttttaagatgaagtctcg

SEQ ID NO: 26444 - DNA, 20 bp, Artificial Sequence
  Description of Artificial Sequence: Synthetic oligonucleotide
  Target: FXN; (-) strand; PAM type: YTN; PAM sequence: CTT
tttttttaagatgaagtctc

SEQ ID NO: 26445 - DNA, 20 bp, Artificial Sequence
  Description of Artificial Sequence: Synthetic oligonucleotide
  Target: FXN; (-) strand; PAM type: YTN; PAM sequence: TTC
tttttttttaagatgaagtc

SEQ ID NO: 26446 - DNA, 20 bp, Artificial Sequence
  Description of Artificial Sequence: Synthetic oligonucleotide
  Target: FXN; (-) strand; PAM type: YTN; PAM sequence: TTT
ctttttttttaagatgaagt

SEQ ID NO: 26447 - DNA, 20 bp, Artificial Sequence
  Description of Artificial Sequence: Synthetic oligonucleotide
  Target: FXN; (-) strand; PAM type: YTN; PAM sequence: TTT
tctttttttttaagatgaag

SEQ ID NO: 26448 - DNA, 20 bp, Artificial Sequence
  Description of Artificial Sequence: Synthetic oligonucleotide
  Target: FXN; (-) strand; PAM type: YTN; PAM sequence: CTT
ttctttttttttaagatgaa

SEQ ID NO: 26449 - DNA, 20 bp, Artificial Sequence
  Description of Artificial Sequence: Synthetic oligonucleotide
  Target: FXN; (-) strand; PAM type: YTN; PAM sequence: TTC
ttttctttttttttaagatg

SEQ ID NO: 26450 - DNA, 20 bp, Artificial Sequence
  Description of Artificial Sequence: Synthetic oligonucleotide
  Target: FXN; (-) strand; PAM type: YTN; PAM sequence: TTT
cttttctttttttttaagat

SEQ ID NO: 26451 - DNA, 20 bp, Artificial Sequence
  Description of Artificial Sequence: Synthetic oligonucleotide
  Target: FXN; (-) strand; PAM type: YTN; PAM sequence: TTT
tcttttctttttttttaaga

SEQ ID NO: 26452 - DNA, 20 bp, Artificial Sequence
  Description of Artificial Sequence: Synthetic oligonucleotide
  Target: FXN; (-) strand; PAM type: YTN; PAM sequence: TTT
ttcttttctttttttttaag

SEQ ID NO: 26453 - DNA, 20 bp, Artificial Sequence
  Description of Artificial Sequence: Synthetic oligonucleotide
  Target: FXN; (-) strand; PAM type: YTN; PAM sequence: CTT
tttcttttctttttttttaa

SEQ ID NO: 26454 - DNA, 20 bp, Artificial Sequence
  Description of Artificial Sequence: Synthetic oligonucleotide
  Target: FXN; (-) strand; PAM type: YTN; PAM sequence: TTC
ctttttcttttctttttttt

SEQ ID NO: 26455 - DNA, 20 bp, Artificial Sequence
  Description of Artificial Sequence: Synthetic oligonucleotide
  Target: FXN; (-) strand; PAM type: YTN; PAM sequence: TTT
cctttttcttttcttttttt

SEQ ID NO: 26456 - DNA, 20 bp, Artificial Sequence
  Description of Artificial Sequence: Synthetic oligonucleotide
  Target: FXN; (-) strand; PAM type: YTN; PAM sequence: TTT
tcctttttcttttctttttt

SEQ ID NO: 26457 - DNA, 20 bp, Artificial Sequence
  Description of Artificial Sequence: Synthetic oligonucleotide
  Target: FXN; (-) strand; PAM type: YTN; PAM sequence: TTC
attttcctttttcttttctt

SEQ ID NO: 26458 - DNA, 20 bp, Artificial Sequence
  Description of Artificial Sequence: Synthetic oligonucleotide
  Target: FXN; (-) strand; PAM type: YTN; PAM sequence: TTT
cattttcctttttcttttct

SEQ ID NO: 26459 - DNA, 20 bp, Artificial Sequence
  Description of Artificial Sequence: Synthetic oligonucleotide
  Target: FXN; (-) strand; PAM type: YTN; PAM sequence: CTT
tcattttcctttttcttttc

SEQ ID NO: 26460 - DNA, 20 bp, Artificial Sequence
  Description of Artificial Sequence: Synthetic oligonucleotide
  Target: FXN; (-) strand; PAM type: YTN; PAM sequence: CTC
actttcattttcctttttct

SEQ ID NO: 26461 - DNA, 20 bp, Artificial Sequence
  Description of Artificial Sequence: Synthetic oligonucleotide
  Target: FXN; (-) strand; PAM type: YTN; PAM sequence: CTG
tacctcactttcattttcct

SEQ ID NO: 26462 - DNA, 20 bp, Artificial Sequence
  Description of Artificial Sequence: Synthetic oligonucleotide
  Target: FXN; (-) strand; PAM type: YTN; PAM sequence: TTC
tgtacctcactttcattttc

SEQ ID NO: 26463 - DNA, 20 bp, Artificial Sequence
  Description of Artificial Sequence: Synthetic oligonucleotide
  Target: FXN; (-) strand; PAM type: YTN; PAM sequence: TTT
ctgtacctcactttcatttt

SEQ ID NO: 26464 - DNA, 20 bp, Artificial Sequence
  Description of Artificial Sequence: Synthetic oligonucleotide
  Target: FXN; (-) strand; PAM type: YTN; PAM sequence: CTG
tttctgtacctcactttcat

SEQ ID NO: 26465 - DNA, 20 bp, Artificial Sequence
  Description of Artificial Sequence: Synthetic oligonucleotide
  Target: FXN; (-) strand; PAM type: YTN; PAM sequence: CTG
gctgtttctgtacctcactt

SEQ ID NO: 26466 - DNA, 20 bp, Artificial Sequence
  Description of Artificial Sequence: Synthetic oligonucleotide
  Target: FXN; (-) strand; PAM type: YTN; PAM sequence: CTG
taaccaacctggctgtttct

SEQ ID NO: 26467 - DNA, 20 bp, Artificial Sequence
  Description of Artificial Sequence: Synthetic oligonucleotide
  Target: FXN; (-) strand; PAM type: YTN; PAM sequence: TTA
aggcaaacaccaagctgtaa

SEQ ID NO: 26468 - DNA, 20 bp, Artificial Sequence
  Description of Artificial Sequence: Synthetic oligonucleotide
  Target: FXN; (-) strand; PAM type: YTN; PAM sequence: TTT
aaggcaaacaccaagctgta

SEQ ID NO: 26469 - DNA, 20 bp, Artificial Sequence
  Description of Artificial Sequence: Synthetic oligonucleotide
  Target: FXN; (-) strand; PAM type: YTN; PAM sequence: TTC
aaaccaagtttaaggcaaac

SEQ ID NO: 26470 - DNA, 20 bp, Artificial Sequence
  Description of Artificial Sequence: Synthetic oligonucleotide
  Target: FXN; (-) strand; PAM type: YTN; PAM sequence: CTG
ttcaaaccaagtttaaggca

SEQ ID NO: 26471 - DNA, 20 bp, Artificial Sequence
  Description of Artificial Sequence: Synthetic oligonucleotide
  Target: FXN; (-) strand; PAM type: YTN; PAM sequence: CTA
atcaaaggcggccaactgtt

SEQ ID NO: 26472 - DNA, 20 bp, Artificial Sequence
  Description of Artificial Sequence: Synthetic oligonucleotide
  Target: FXN; (-) strand; PAM type: YTN; PAM sequence: TTG
gctaatcaaaggcggccaac

SEQ ID NO: 26473 - DNA, 20 bp, Artificial Sequence
  Description of Artificial Sequence: Synthetic oligonucleotide
  Target: FXN; (-) strand; PAM type: YTN; PAM sequence: TTT
ggctaatcaaaggcggccaa

SEQ ID NO: 26474 - DNA, 20 bp, Artificial Sequence
  Description of Artificial Sequence: Synthetic oligonucleotide
  Target: FXN; (-) strand; PAM type: YTN; PAM sequence: TTT
tggctaatcaaaggcggcca

SEQ ID NO: 26475 - DNA, 20 bp, Artificial Sequence
  Description of Artificial Sequence: Synthetic oligonucleotide
  Target: FXN; (-) strand; PAM type: YTN; PAM sequence: TTG
taccaatcaccgagttttgg

SEQ ID NO: 26476 - DNA, 20 bp, Artificial Sequence
  Description of Artificial Sequence: Synthetic oligonucleotide
  Target: FXN; (-) strand; PAM type: YTN; PAM sequence: CTT
gtaccaatcaccgagttttg

SEQ ID NO: 26477 - DNA, 20 bp, Artificial Sequence
  Description of Artificial Sequence: Synthetic oligonucleotide
  Target: FXN; (-) strand; PAM type: YTN; PAM sequence: CTC
ttgtaccaatcaccgagttt

SEQ ID NO: 26478 - DNA, 20 bp, Artificial Sequence
  Description of Artificial Sequence: Synthetic oligonucleotide
  Target: FXN; (-) strand; PAM type: YTN; PAM sequence: CTA
ctcttgtaccaatcaccgag

SEQ ID NO: 26479 - DNA, 20 bp, Artificial Sequence
  Description of Artificial Sequence: Synthetic oligonucleotide
  Target: FXN; (-) strand; PAM type: YTN; PAM sequence: CTG
caatctactcttgtaccaat

SEQ ID NO: 26480 - DNA, 20 bp, Artificial Sequence
  Description of Artificial Sequence: Synthetic oligonucleotide
  Target: FXN; (-) strand; PAM type: YTN; PAM sequence: CTG
tacatagtgaactgcaatct

SEQ ID NO: 26481 - DNA, 20 bp, Artificial Sequence
  Description of Artificial Sequence: Synthetic oligonucleotide
  Target: FXN; (-) strand; PAM type: YTN; PAM sequence: CTC
tgtacatagtgaactgcaat

SEQ ID NO: 26482 - DNA, 20 bp, Artificial Sequence
  Description of Artificial Sequence: Synthetic oligonucleotide
  Target: FXN; (-) strand; PAM type: YTN; PAM sequence: TTC
tctgtacatagtgaactgca

SEQ ID NO: 26483 - DNA, 20 bp, Artificial Sequence
  Description of Artificial Sequence: Synthetic oligonucleotide
  Target: FXN; (-) strand; PAM type: YTN; PAM sequence: CTT
ctctgtacatagtgaactgc

SEQ ID NO: 26484 - DNA, 20 bp, Artificial Sequence
  Description of Artificial Sequence: Synthetic oligonucleotide
  Target: FXN; (-) strand; PAM type: YTN; PAM sequence: CTA
agggcttctctgtacatagt

SEQ ID NO: 26485 - DNA, 20 bp, Artificial Sequence
  Description of Artificial Sequence: Synthetic oligonucleotide
  Target: FXN; (-) strand; PAM type: YTN; PAM sequence: TTC
ggatctaagggcttctctgt

SEQ ID NO: 26486 - DNA, 20 bp, Artificial Sequence
  Description of Artificial Sequence: Synthetic oligonucleotide
  Target: FXN; (-) strand; PAM type: YTN; PAM sequence: TTG
agttcggatctaagggcttc

SEQ ID NO: 26487 - DNA, 20 bp, Artificial Sequence
  Description of Artificial Sequence: Synthetic oligonucleotide
  Target: FXN; (-) strand; PAM type: YTN; PAM sequence: TTT
gagttcggatctaagggctt

SEQ ID NO: 26488 - DNA, 20 bp, Artificial Sequence
  Description of Artificial Sequence: Synthetic oligonucleotide
  Target: FXN; (-) strand; PAM type: YTN; PAM sequence: TTT
tgagttcggatctaagggct

SEQ ID NO: 26489 - DNA, 20 bp, Artificial Sequence
  Description of Artificial Sequence: Synthetic oligonucleotide
  Target: FXN; (-) strand; PAM type: YTN; PAM sequence: CTA
ttttgagttcggatctaagg

SEQ ID NO: 26490 - DNA, 20 bp, Artificial Sequence
  Description of Artificial Sequence: Synthetic oligonucleotide
  Target: FXN; (-) strand; PAM type: YTN; PAM sequence: TTA
cctattttgagttcggatct

SEQ ID NO: 26491 - DNA, 20 bp, Artificial Sequence
  Description of Artificial Sequence: Synthetic oligonucleotide
  Target: FXN; (-) strand; PAM type: YTN; PAM sequence: CTT
acctattttgagttcggatc

SEQ ID NO: 26492 - DNA, 20 bp, Artificial Sequence
  Description of Artificial Sequence: Synthetic oligonucleotide
  Target: FXN; (-) strand; PAM type: YTN; PAM sequence: CTC
cttacctattttgagttcgg

SEQ ID NO: 26493 - DNA, 20 bp, Artificial Sequence
  Description of Artificial Sequence: Synthetic oligonucleotide
  Target: FXN; (-) strand; PAM type: YTN; PAM sequence: CTG
cctccttacctattttgagt

SEQ ID NO: 26494 - DNA, 20 bp, Artificial Sequence
  Description of Artificial Sequence: Synthetic oligonucleotide
  Target: FXN; (-) strand; PAM type: YTN; PAM sequence: CTA
aaactgcctccttacctatt

SEQ ID NO: 26495 - DNA, 20 bp, Artificial Sequence
  Description of Artificial Sequence: Synthetic oligonucleotide
  Target: FXN; (-) strand; PAM type: YTN; PAM sequence: TTA
agtgtagctaaaactgcctc

SEQ ID NO: 26496 - DNA, 20 bp, Artificial Sequence
  Description of Artificial Sequence: Synthetic oligonucleotide
  Target: FXN; (-) strand; PAM type: YTN; PAM sequence: CTT
aagtgtagctaaaactgcct

SEQ ID NO: 26497 - DNA, 20 bp, Artificial Sequence
  Description of Artificial Sequence: Synthetic oligonucleotide
  Target: FXN; (-) strand; PAM type: YTN; PAM sequence: TTA
acttaagtgtagctaaaact

SEQ ID NO: 26498 - DNA, 20 bp, Artificial Sequence
  Description of Artificial Sequence: Synthetic oligonucleotide
  Target: FXN; (-) strand; PAM type: YTN; PAM sequence: CTG
agtatgttaacttaagtgta

SEQ ID NO: 26499 - DNA, 20 bp, Artificial Sequence
  Description of Artificial Sequence: Synthetic oligonucleotide
  Target: FXN; (-) strand; PAM type: YTN; PAM sequence: CTC
ctgagtatgttaacttaagt

SEQ ID NO: 26500 - DNA, 20 bp, Artificial Sequence
  Description of Artificial Sequence: Synthetic oligonucleotide
  Target: FXN; (-) strand; PAM type: YTN; PAM sequence: CTG
gaatggtactcctgagtatg

SEQ ID NO: 26501 - DNA, 20 bp, Artificial Sequence
  Description of Artificial Sequence: Synthetic oligonucleotide
  Target: FXN; (-) strand; PAM type: YTN; PAM sequence: TTG
aagctggaatggtactcctg

SEQ ID NO: 26502 - DNA, 20 bp, Artificial Sequence
  Description of Artificial Sequence: Synthetic oligonucleotide
  Target: FXN; (-) strand; PAM type: YTN; PAM sequence: CTT
gaagctggaatggtactcct

SEQ ID NO: 26503 - DNA, 20 bp, Artificial Sequence
  Description of Artificial Sequence: Synthetic oligonucleotide
  Target: FXN; (-) strand; PAM type: YTN; PAM sequence: TTC
cagcttgaagctggaatggt

SEQ ID NO: 26504 - DNA, 20 bp, Artificial Sequence
  Description of Artificial Sequence: Synthetic oligonucleotide
  Target: FXN; (-) strand; PAM type: YTN; PAM sequence: CTT
ccagcttgaagctggaatgg

SEQ ID NO: 26505 - DNA, 20 bp, Artificial Sequence
  Description of Artificial Sequence: Synthetic oligonucleotide
  Target: FXN; (-) strand; PAM type: YTN; PAM sequence: CTG
cagacacttccagcttgaag

SEQ ID NO: 26506 - DNA, 20 bp, Artificial Sequence
  Description of Artificial Sequence: Synthetic oligonucleotide
  Target: FXN; (-) strand; PAM type: YTN; PAM sequence: CTC
agggggctgcagacacttcc

SEQ ID NO: 26507 - DNA, 20 bp, Artificial Sequence
  Description of Artificial Sequence: Synthetic oligonucleotide
  Target: FXN; (-) strand; PAM type: YTN; PAM sequence: TTA
agtggtctcagggggctgca

SEQ ID NO: 26508 - DNA, 20 bp, Artificial Sequence
  Description of Artificial Sequence: Synthetic oligonucleotide
  Target: FXN; (-) strand; PAM type: YTN; PAM sequence: TTG
ggattaagtggtctcagggg

SEQ ID NO: 26509 - DNA, 20 bp, Artificial Sequence
  Description of Artificial Sequence: Synthetic oligonucleotide
  Target: FXN; (-) strand; PAM type: YTN; PAM sequence: CTT
gggattaagtggtctcaggg

SEQ ID NO: 26510 - DNA, 20 bp, Artificial Sequence
  Description of Artificial Sequence: Synthetic oligonucleotide
  Target: FXN; (-) strand; PAM type: YTN; PAM sequence: TTA
acttgggattaagtggtctc

SEQ ID NO: 26511 - DNA, 20 bp, Artificial Sequence
  Description of Artificial Sequence: Synthetic oligonucleotide
  Target: FXN; (-) strand; PAM type: YTN; PAM sequence: TTT
aacttgggattaagtggtct

SEQ ID NO: 26512 - DNA, 20 bp, Artificial Sequence
  Description of Artificial Sequence: Synthetic oligonucleotide
  Target: FXN; (-) strand; PAM type: YTN; PAM sequence: TTT
taacttgggattaagtggtc

SEQ ID NO: 26513 - DNA, 20 bp, Artificial Sequence
  Description of Artificial Sequence: Synthetic oligonucleotide
  Target: FXN; (-) strand; PAM type: YTN; PAM sequence: TTT
ttaacttgggattaagtggt

SEQ ID NO: 26514 - DNA, 20 bp, Artificial Sequence
  Description of Artificial Sequence: Synthetic oligonucleotide
  Target: FXN; (-) strand; PAM type: YTN; PAM sequence: CTG
agcaggggtttttaacttgg

SEQ ID NO: 26515 - DNA, 20 bp, Artificial Sequence
  Description of Artificial Sequence: Synthetic oligonucleotide
  Target: FXN; (-) strand; PAM type: YTN; PAM sequence: CTC
tgagcaggggtttttaactt

SEQ ID NO: 26516 - DNA, 20 bp, Artificial Sequence
  Description of Artificial Sequence: Synthetic oligonucleotide
  Target: FXN; (-) strand; PAM type: YTN; PAM sequence: CTG
cctctgagcaggggttttta

SEQ ID NO: 26517 - DNA, 20 bp, Artificial Sequence
  Description of Artificial Sequence: Synthetic oligonucleotide
  Target: FXN; (-) strand; PAM type: YTN; PAM sequence: CTC
aaaaaaaaaaaaaaaaaaaa

SEQ ID NO: 26518 - DNA, 20 bp, Artificial Sequence
  Description of Artificial Sequence: Synthetic oligonucleotide
  Target: FXN; (-) strand; PAM type: YTN; PAM sequence: CTC
tcaaaaaaaaaaaaaaaaaa

SEQ ID NO: 26519 - DNA, 20 bp, Artificial Sequence
  Description of Artificial Sequence: Synthetic oligonucleotide
  Target: FXN; (-) strand; PAM type: YTN; PAM sequence: CTC
tctcaaaaaaaaaaaaaaaa

SEQ ID NO: 26520 - DNA, 20 bp, Artificial Sequence
  Description of Artificial Sequence: Synthetic oligonucleotide
  Target: FXN; (-) strand; PAM type: YTN; PAM sequence: CTG
ggtgacagagtgagatctct

SEQ ID NO: 26521 - DNA, 20 bp, Artificial Sequence
  Description of Artificial Sequence: Synthetic oligonucleotide
  Target: FXN; (-) strand; PAM type: YTN; PAM sequence: CTC
cagcctgggtgacagagtga

SEQ ID NO: 26522 - DNA, 20 bp, Artificial Sequence
  Description of Artificial Sequence: Synthetic oligonucleotide
  Target: FXN; (-) strand; PAM type: YTN; PAM sequence: CTG
cactccagcctgggtgacag

SEQ ID NO: 26523 - DNA, 20 bp, Artificial Sequence
  Description of Artificial Sequence: Synthetic oligonucleotide
  Target: FXN; (-) strand; PAM type: YTN; PAM sequence: CTG
agatcgtgccactgcactcc

SEQ ID NO: 26524 - DNA, 20 bp, Artificial Sequence
  Description of Artificial Sequence: Synthetic oligonucleotide
  Target: FXN; (-) strand; PAM type: YTN; PAM sequence: TTG
cagtgagctgagatcgtgcc

SEQ ID NO: 26525 - DNA, 20 bp, Artificial Sequence
  Description of Artificial Sequence: Synthetic oligonucleotide
  Target: FXN; (-) strand; PAM type: YTN; PAM sequence: TTG
agcccaggaggtggtggttg

SEQ ID NO: 26526 - DNA, 20 bp, Artificial Sequence
  Description of Artificial Sequence: Synthetic oligonucleotide
  Target: FXN; (-) strand; PAM type: YTN; PAM sequence: CTT
gagcccaggaggtggtggtt

SEQ ID NO: 26527 - DNA, 20 bp, Artificial Sequence
  Description of Artificial Sequence: Synthetic oligonucleotide
  Target: FXN; (-) strand; PAM type: YTN; PAM sequence: CTG
aggcaagagaatcccttgag

SEQ ID NO: 26528 - DNA, 20 bp, Artificial Sequence
  Description of Artificial Sequence: Synthetic oligonucleotide
  Target: FXN; (-) strand; PAM type: YTN; PAM sequence: CTC
gggagactgaggcaagagaa

SEQ ID NO: 26529 - DNA, 20 bp, Artificial Sequence
  Description of Artificial Sequence: Synthetic oligonucleotide
  Target: FXN; (-) strand; PAM type: YTN; PAM sequence: TTA
ctcgggagactgaggcaaga

SEQ ID NO: 26530 - DNA, 20 bp, Artificial Sequence
  Description of Artificial Sequence: Synthetic oligonucleotide
  Target: FXN; (-) strand; PAM type: YTN; PAM sequence: CTG
taatcccagttactcgggag

SEQ ID NO: 26531 - DNA, 20 bp, Artificial Sequence
  Description of Artificial Sequence: Synthetic oligonucleotide
  Target: FXN; (-) strand; PAM type: YTN; PAM sequence: CTG
gacatagtggcacgcgcctg

SEQ ID NO: 26532 - DNA, 20 bp, Artificial Sequence
  Description of Artificial Sequence: Synthetic oligonucleotide
  Target: FXN; (-) strand; PAM type: YTN; PAM sequence: TTA
gctggacatagtggcacgcg

SEQ ID NO: 26533 - DNA, 20 bp, Artificial Sequence
  Description of Artificial Sequence: Synthetic oligonucleotide
  Target: FXN; (-) strand; PAM type: YTN; PAM sequence: CTA
aaaatacaaaaaaaaaaatt

SEQ ID NO: 26534 - DNA, 20 bp, Artificial Sequence
  Description of Artificial Sequence: Synthetic oligonucleotide
  Target: FXN; (-) strand; PAM type: YTN; PAM sequence: CTA
ctaaaaatacaaaaaaaaaa

SEQ ID NO: 26535 - DNA, 20 bp, Artificial Sequence
  Description of Artificial Sequence: Synthetic oligonucleotide
  Target: FXN; (-) strand; PAM type: YTN; PAM sequence: CTC
tactaaaaatacaaaaaaaa

SEQ ID NO: 26536 - DNA, 20 bp, Artificial Sequence
  Description of Artificial Sequence: Synthetic oligonucleotide
  Target: FXN; (-) strand; PAM type: YTN; PAM sequence: TTC
aagaccagccaggccaacat

SEQ ID NO: 26537 - DNA, 20 bp, Artificial Sequence
  Description of Artificial Sequence: Synthetic oligonucleotide
  Target: FXN; (-) strand; PAM type: YTN; PAM sequence: TTG
aggtcaagagttcaagacca

SEQ ID NO: 26538 - DNA, 20 bp, Artificial Sequence
  Description of Artificial Sequence: Synthetic oligonucleotide
  Target: FXN; (-) strand; PAM type: YTN; PAM sequence: CTT
gaggtcaagagttcaagacc

SEQ ID NO: 26539 - DNA, 20 bp, Artificial Sequence
  Description of Artificial Sequence: Synthetic oligonucleotide
  Target: FXN; (-) strand; PAM type: YTN; PAM sequence: CTG
aggccagtggatcacttgag

SEQ ID NO: 26540 - DNA, 20 bp, Artificial Sequence
  Description of Artificial Sequence: Synthetic oligonucleotide
  Target: FXN; (-) strand; PAM type: YTN; PAM sequence: TTG
ggaggctgaggccagtggat

SEQ ID NO: 26541 - DNA, 20 bp, Artificial Sequence
  Description of Artificial Sequence: Synthetic oligonucleotide
  Target: FXN; (-) strand; PAM type: YTN; PAM sequence: TTT
gggaggctgaggccagtgga

SEQ ID NO: 26542 - DNA, 20 bp, Artificial Sequence
  Description of Artificial Sequence: Synthetic oligonucleotide
  Target: FXN; (-) strand; PAM type: YTN; PAM sequence: CTT
tgggaggctgaggccagtgg

SEQ ID NO: 26543 - DNA, 20 bp, Artificial Sequence
  Description of Artificial Sequence: Synthetic oligonucleotide
  Target: FXN; (-) strand; PAM type: YTN; PAM sequence: CTA
atgccagcactttgggaggc

SEQ ID NO: 26544 - DNA, 20 bp, Artificial Sequence
  Description of Artificial Sequence: Synthetic oligonucleotide
  Target: FXN; (-) strand; PAM type: YTN; PAM sequence: CTC
taatgccagcactttgggag

SEQ ID NO: 26545 - DNA, 20 bp, Artificial Sequence
  Description of Artificial Sequence: Synthetic oligonucleotide
  Target: FXN; (-) strand; PAM type: YTN; PAM sequence: CTC
acacctctaatgccagcact

SEQ ID NO: 26546 - DNA, 20 bp, Artificial Sequence
  Description of Artificial Sequence: Synthetic oligonucleotide
  Target: FXN; (-) strand; PAM type: YTN; PAM sequence: CTG
ggccaggaacagtgactcac

SEQ ID NO: 26547 - DNA, 20 bp, Artificial Sequence
  Description of Artificial Sequence: Synthetic oligonucleotide
  Target: FXN; (-) strand; PAM type: YTN; PAM sequence: CTC
actgggccaggaacagtgac

SEQ ID NO: 26548 - DNA, 20 bp, Artificial Sequence
  Description of Artificial Sequence: Synthetic oligonucleotide
  Target: FXN; (-) strand; PAM type: YTN; PAM sequence: CTC
catatccaatgagatggtgc

SEQ ID NO: 26549 - DNA, 20 bp, Artificial Sequence
  Description of Artificial Sequence: Synthetic oligonucleotide
  Target: FXN; (-) strand; PAM type: YTN; PAM sequence: TTG
tctccatatccaatgagatg

SEQ ID NO: 26550 - DNA, 20 bp, Artificial Sequence
  Description of Artificial Sequence: Synthetic oligonucleotide
  Target: FXN; (-) strand; PAM type: YTN; PAM sequence: TTT
gtctccatatccaatgagat

SEQ ID NO: 26551 - DNA, 20 bp, Artificial Sequence
  Description of Artificial Sequence: Synthetic oligonucleotide
  Target: FXN; (-) strand; PAM type: YTN; PAM sequence: CTT
tgtctccatatccaatgaga

SEQ ID NO: 26552 - DNA, 20 bp, Artificial Sequence
  Description of Artificial Sequence: Synthetic oligonucleotide
  Target: FXN; (-) strand; PAM type: YTN; PAM sequence: CTA
agccagatcctttgtctcca

SEQ ID NO: 26553 - DNA, 20 bp, Artificial Sequence
  Description of Artificial Sequence: Synthetic oligonucleotide
  Target: FXN; (-) strand; PAM type: YTN; PAM sequence: TTG
gaaagaaaatacaaatccag

SEQ ID NO: 26554 - DNA, 20 bp, Artificial Sequence
  Description of Artificial Sequence: Synthetic oligonucleotide
  Target: FXN; (-) strand; PAM type: YTN; PAM sequence: CTT
ggaaagaaaatacaaatcca

SEQ ID NO: 26555 - DNA, 20 bp, Artificial Sequence
  Description of Artificial Sequence: Synthetic oligonucleotide
  Target: FXN; (-) strand; PAM type: YTN; PAM sequence: CTC
ttggaaagaaaatacaaatc

SEQ ID NO: 26556 - DNA, 20 bp, Artificial Sequence
  Description of Artificial Sequence: Synthetic oligonucleotide
  Target: FXN; (-) strand; PAM type: YTN; PAM sequence: TTA
aggactcttggaaagaaaat

SEQ ID NO: 26557 - DNA, 20 bp, Artificial Sequence
  Description of Artificial Sequence: Synthetic oligonucleotide
  Target: FXN; (-) strand; PAM type: YTN; PAM sequence: CTT
aaggactcttggaaagaaaa

SEQ ID NO: 26558 - DNA, 20 bp, Artificial Sequence
  Description of Artificial Sequence: Synthetic oligonucleotide
  Target: FXN; (-) strand; PAM type: YTN; PAM sequence: TTA
gatatcacttaaggactctt

SEQ ID NO: 26559 - DNA, 20 bp, Artificial Sequence
  Description of Artificial Sequence: Synthetic oligonucleotide
  Target: FXN; (-) strand; PAM type: YTN; PAM sequence: CTC
gcaaaagttagatatcactt

SEQ ID NO: 26560 - DNA, 20 bp, Artificial Sequence
  Description of Artificial Sequence: Synthetic oligonucleotide
  Target: FXN; (-) strand; PAM type: YTN; PAM sequence: CTG
cagctcgcaaaagttagata

SEQ ID NO: 26561 - DNA, 20 bp, Artificial Sequence
  Description of Artificial Sequence: Synthetic oligonucleotide
  Target: FXN; (-) strand; PAM type: YTN; PAM sequence: CTG
aggaaactgcagctcgcaaa

SEQ ID NO: 26562 - DNA, 20 bp, Artificial Sequence
  Description of Artificial Sequence: Synthetic oligonucleotide
  Target: FXN; (-) strand; PAM type: YTN; PAM sequence: CTC
atagctgaggaaactgcagc

SEQ ID NO: 26563 - DNA, 20 bp, Artificial Sequence
  Description of Artificial Sequence: Synthetic oligonucleotide
  Target: FXN; (-) strand; PAM type: YTN; PAM sequence: CTC
atctcatagctgaggaaact

SEQ ID NO: 26564 - DNA, 20 bp, Artificial Sequence
  Description of Artificial Sequence: Synthetic oligonucleotide
  Target: FXN; (-) strand; PAM type: YTN; PAM sequence: TTA
atgtcactcatctcatagct

SEQ ID NO: 26565 - DNA, 20 bp, Artificial Sequence
  Description of Artificial Sequence: Synthetic oligonucleotide
  Target: FXN; (-) strand; PAM type: YTN; PAM sequence: CTG
aagagaggaggttaatgtca

SEQ ID NO: 26566 - DNA, 20 bp, Artificial Sequence
  Description of Artificial Sequence: Synthetic oligonucleotide
  Target: FXN; (-) strand; PAM type: YTN; PAM sequence: TTA
taaatctgaagagaggaggt

SEQ ID NO: 26567 - DNA, 20 bp, Artificial Sequence
  Description of Artificial Sequence: Synthetic oligonucleotide
  Target: FXN; (-) strand; PAM type: YTN; PAM sequence: CTT
ataaatctgaagagaggagg

SEQ ID NO: 26568 - DNA, 20 bp, Artificial Sequence
  Description of Artificial Sequence: Synthetic oligonucleotide
  Target: FXN; (-) strand; PAM type: YTN; PAM sequence: CTC
ttataaatctgaagagagga

SEQ ID NO: 26569 - DNA, 20 bp, Artificial Sequence
  Description of Artificial Sequence: Synthetic oligonucleotide
  Target: FXN; (-) strand; PAM type: YTN; PAM sequence: TTG
atcctcttataaatctgaag

SEQ ID NO: 26570 - DNA, 20 bp, Artificial Sequence
  Description of Artificial Sequence: Synthetic oligonucleotide
  Target: FXN; (-) strand; PAM type: YTN; PAM sequence: TTA
attgatcctcttataaatct

SEQ ID NO: 26571 - DNA, 20 bp, Artificial Sequence
  Description of Artificial Sequence: Synthetic oligonucleotide
  Target: FXN; (-) strand; PAM type: YTN; PAM sequence: TTT
aattgatcctcttataaatc

SEQ ID NO: 26572 - DNA, 20 bp, Artificial Sequence
  Description of Artificial Sequence: Synthetic oligonucleotide
  Target: FXN; (-) strand; PAM type: YTN; PAM sequence: TTT
taattgatcctcttataaat

SEQ ID NO: 26573 - DNA, 20 bp, Artificial Sequence
  Description of Artificial Sequence: Synthetic oligonucleotide
  Target: FXN; (-) strand; PAM type: YTN; PAM sequence: CTA
tgccattttaattgatcctc

SEQ ID NO: 26574 - DNA, 20 bp, Artificial Sequence
  Description of Artificial Sequence: Synthetic oligonucleotide
  Target: FXN; (-) strand; PAM type: YTN; PAM sequence: TTA
cctatgccattttaattgat

SEQ ID NO: 26575 - DNA, 20 bp, Artificial Sequence
  Description of Artificial Sequence: Synthetic oligonucleotide
  Target: FXN; (-) strand; PAM type: YTN; PAM sequence: TTT
acctatgccattttaattga

SEQ ID NO: 26576 - DNA, 20 bp, Artificial Sequence
  Description of Artificial Sequence: Synthetic oligonucleotide
  Target: FXN; (-) strand; PAM type: YTN; PAM sequence: TTT
tacctatgccattttaattg

SEQ ID NO: 26577 - DNA, 20 bp, Artificial Sequence
  Description of Artificial Sequence: Synthetic oligonucleotide
  Target: FXN; (-) strand; PAM type: YTN; PAM sequence: CTT
ttacctatgccattttaatt

SEQ ID NO: 26578 - DNA, 20 bp, Artificial Sequence
  Description of Artificial Sequence: Synthetic oligonucleotide
  Target: FXN; (-) strand; PAM type: YTN; PAM sequence: CTA
ggatgcacttttacctatgc

SEQ ID NO: 26579 - DNA, 20 bp, Artificial Sequence
  Description of Artificial Sequence: Synthetic oligonucleotide
  Target: FXN; (-) strand; PAM type: YTN; PAM sequence: TTG
ctaggatgcacttttaccta

SEQ ID NO: 26580 - DNA, 20 bp, Artificial Sequence
  Description of Artificial Sequence: Synthetic oligonucleotide
  Target: FXN; (-) strand; PAM type: YTN; PAM sequence: CTT
gctaggatgcacttttacct

SEQ ID NO: 26581 - DNA, 20 bp, Artificial Sequence
  Description of Artificial Sequence: Synthetic oligonucleotide
  Target: FXN; (-) strand; PAM type: YTN; PAM sequence: CTA
aagtagataccaacttgcta

SEQ ID NO: 26582 - DNA, 20 bp, Artificial Sequence
  Description of Artificial Sequence: Synthetic oligonucleotide
  Target: FXN; (-) strand; PAM type: YTN; PAM sequence: TTC
taaagtagataccaacttgc

SEQ ID NO: 26583 - DNA, 20 bp, Artificial Sequence
  Description of Artificial Sequence: Synthetic oligonucleotide
  Target: FXN; (-) strand; PAM type: YTN; PAM sequence: TTT
ctaaagtagataccaacttg

SEQ ID NO: 26584 - DNA, 20 bp, Artificial Sequence
  Description of Artificial Sequence: Synthetic oligonucleotide
  Target: FXN; (-) strand; PAM type: YTN; PAM sequence: TTC
atttctaaagtagataccaa

SEQ ID NO: 26585 - DNA, 20 bp, Artificial Sequence
  Description of Artificial Sequence: Synthetic oligonucleotide
  Target: FXN; (-) strand; PAM type: YTN; PAM sequence: CTT
catttctaaagtagatacca

SEQ ID NO: 26586 - DNA, 20 bp, Artificial Sequence
  Description of Artificial Sequence: Synthetic oligonucleotide
  Target: FXN; (-) strand; PAM type: YTN; PAM sequence: CTC
cttcatttctaaagtagata

SEQ ID NO: 26587 - DNA, 20 bp, Artificial Sequence
  Description of Artificial Sequence: Synthetic oligonucleotide
  Target: FXN; (-) strand; PAM type: YTN; PAM sequence: TTC
acatacatatgacctccttc

SEQ ID NO: 26588 - DNA, 20 bp, Artificial Sequence
  Description of Artificial Sequence: Synthetic oligonucleotide
  Target: FXN; (-) strand; PAM type: YTN; PAM sequence: CTT
cacatacatatgacctcctt

SEQ ID NO: 26589 - DNA, 20 bp, Artificial Sequence
  Description of Artificial Sequence: Synthetic oligonucleotide
  Target: FXN; (-) strand; PAM type: YTN; PAM sequence: CTG
gagacttcacatacatatga

SEQ ID NO: 26590 - DNA, 20 bp, Artificial Sequence
  Description of Artificial Sequence: Synthetic oligonucleotide
  Target: FXN; (-) strand; PAM type: YTN; PAM sequence: TTG
ggtctggagacttcacatac

SEQ ID NO: 26591 - DNA, 20 bp, Artificial Sequence
  Description of Artificial Sequence: Synthetic oligonucleotide
  Target: FXN; (-) strand; PAM type: YTN; PAM sequence: TTG
tagaaatagacacatataag

SEQ ID NO: 26592 - DNA, 20 bp, Artificial Sequence
  Description of Artificial Sequence: Synthetic oligonucleotide
  Target: FXN; (-) strand; PAM type: YTN; PAM sequence: CTT
gtagaaatagacacatataa

SEQ ID NO: 26593 - DNA, 20 bp, Artificial Sequence
  Description of Artificial Sequence: Synthetic oligonucleotide
  Target: FXN; (-) strand; PAM type: YTN; PAM sequence: CTC
acttgtagaaatagacacat

SEQ ID NO: 26594 - DNA, 20 bp, Artificial Sequence
  Description of Artificial Sequence: Synthetic oligonucleotide
  Target: FXN; (-) strand; PAM type: YTN; PAM sequence: CTA
gctcacttgtagaaatagac

SEQ ID NO: 26595 - DNA, 20 bp, Artificial Sequence
  Description of Artificial Sequence: Synthetic oligonucleotide
  Target: FXN; (-) strand; PAM type: YTN; PAM sequence: TTG
tcactagctcacttgtagaa

SEQ ID NO: 26596 - DNA, 20 bp, Artificial Sequence
  Description of Artificial Sequence: Synthetic oligonucleotide
  Target: FXN; (-) strand; PAM type: YTN; PAM sequence: CTG
ttgtcactagctcacttgta

SEQ ID NO: 26597 - DNA, 20 bp, Artificial Sequence
  Description of Artificial Sequence: Synthetic oligonucleotide
  Target: FXN; (-) strand; PAM type: YTN; PAM sequence: TTA
ctgttgtcactagctcactt

SEQ ID NO: 26598 - DNA, 20 bp, Artificial Sequence
  Description of Artificial Sequence: Synthetic oligonucleotide
  Target: FXN; (-) strand; PAM type: YTN; PAM sequence: CTA
cccatgtaggagcaaaaata

SEQ ID NO: 26599 - DNA, 20 bp, Artificial Sequence
  Description of Artificial Sequence: Synthetic oligonucleotide
  Target: FXN; (-) strand; PAM type: YTN; PAM sequence: CTA
gtcaagatcagccctaccca

SEQ ID NO: 26600 - DNA, 20 bp, Artificial Sequence
  Description of Artificial Sequence: Synthetic oligonucleotide
  Target: FXN; (-) strand; PAM type: YTN; PAM sequence: CTC
ctagtcaagatcagccctac

SEQ ID NO: 26601 - DNA, 20 bp, Artificial Sequence
  Description of Artificial Sequence: Synthetic oligonucleotide
  Target: FXN; (-) strand; PAM type: YTN; PAM sequence: CTC
ctcctagtcaagatcagccc

SEQ ID NO: 26602 - DNA, 20 bp, Artificial Sequence
  Description of Artificial Sequence: Synthetic oligonucleotide
  Target: FXN; (-) strand; PAM type: YTN; PAM sequence: TTG
actcctcctagtcaagatca

SEQ ID NO: 26603 - DNA, 20 bp, Artificial Sequence
  Description of Artificial Sequence: Synthetic oligonucleotide
  Target: FXN; (-) strand; PAM type: YTN; PAM sequence: TTA
ttgactcctcctagtcaaga

SEQ ID NO: 26604 - DNA, 20 bp, Artificial Sequence
  Description of Artificial Sequence: Synthetic oligonucleotide
  Target: FXN; (-) strand; PAM type: YTN; PAM sequence: CTT
attgactcctcctagtcaag

SEQ ID NO: 26605 - DNA, 20 bp, Artificial Sequence
  Description of Artificial Sequence: Synthetic oligonucleotide
  Target: FXN; (-) strand; PAM type: YTN; PAM sequence: CTG
gtgagtcttattgactcctc

SEQ ID NO: 26606 - DNA, 20 bp, Artificial Sequence
  Description of Artificial Sequence: Synthetic oligonucleotide
  Target: FXN; (-) strand; PAM type: YTN; PAM sequence: TTA
caggcgtgagccaccacgcc

SEQ ID NO: 26607 - DNA, 20 bp, Artificial Sequence
  Description of Artificial Sequence: Synthetic oligonucleotide
  Target: FXN; (-) strand; PAM type: YTN; PAM sequence: CTG
ggattacaggcgtgagccac

SEQ ID NO: 26608 - DNA, 20 bp, Artificial Sequence
  Description of Artificial Sequence: Synthetic oligonucleotide
  Target: FXN; (-) strand; PAM type: YTN; PAM sequence: CTC
ccaaagtgctgggattacag

SEQ ID NO: 26609 - DNA, 20 bp, Artificial Sequence
  Description of Artificial Sequence: Synthetic oligonucleotide
  Target: FXN; (-) strand; PAM type: YTN; PAM sequence: TTG
gcctcccaaagtgctgggat

SEQ ID NO: 26610 - DNA, 20 bp, Artificial Sequence
  Description of Artificial Sequence: Synthetic oligonucleotide
  Target: FXN; (-) strand; PAM type: YTN; PAM sequence: CTT
ggcctcccaaagtgctggga

SEQ ID NO: 26611 - DNA, 20 bp, Artificial Sequence
  Description of Artificial Sequence: Synthetic oligonucleotide
  Target: FXN; (-) strand; PAM type: YTN; PAM sequence: CTC
gtgatccgcccgccttggcc

SEQ ID NO: 26612 - DNA, 20 bp, Artificial Sequence
  Description of Artificial Sequence: Synthetic oligonucleotide
  Target: FXN; (-) strand; PAM type: YTN; PAM sequence: CTG
acctcgtgatccgcccgcct

SEQ ID NO: 26613 - DNA, 20 bp, Artificial Sequence
  Description of Artificial Sequence: Synthetic oligonucleotide
  Target: FXN; (-) strand; PAM type: YTN; PAM sequence: CTC
ctgacctcgtgatccgcccg

SEQ ID NO: 26614 - DNA, 20 bp, Artificial Sequence
  Description of Artificial Sequence: Synthetic oligonucleotide
  Target: FXN; (-) strand; PAM type: YTN; PAM sequence: CTC
gatctcctgacctcgtgatc

SEQ ID NO: 26615 - DNA, 20 bp, Artificial Sequence
  Description of Artificial Sequence: Synthetic oligonucleotide
  Target: FXN; (-) strand; PAM type: YTN; PAM sequence: TTA
gccagaatggtctcgatctc

SEQ ID NO: 26616 - DNA, 20 bp, Artificial Sequence
  Description of Artificial Sequence: Synthetic oligonucleotide
  Target: FXN; (-) strand; PAM type: YTN; PAM sequence: TTC
accgtgttagccagaatggt

SEQ ID NO: 26617 - DNA, 20 bp, Artificial Sequence
  Description of Artificial Sequence: Synthetic oligonucleotide
  Target: FXN; (-) strand; PAM type: YTN; PAM sequence: TTT
caccgtgttagccagaatgg

SEQ ID NO: 26618 - DNA, 20 bp, Artificial Sequence
  Description of Artificial Sequence: Synthetic oligonucleotide
  Target: FXN; (-) strand; PAM type: YTN; PAM sequence: TTA
gtagagacggggtttcaccg

SEQ ID NO: 26619 - DNA, 20 bp, Artificial Sequence
  Description of Artificial Sequence: Synthetic oligonucleotide
  Target: FXN; (-) strand; PAM type: YTN; PAM sequence: TTT
agtagagacggggtttcacc

SEQ ID NO: 26620 - DNA, 20 bp, Artificial Sequence
  Description of Artificial Sequence: Synthetic oligonucleotide
  Target: FXN; (-) strand; PAM type: YTN; PAM sequence: TTT
tagtagagacggggtttcac

SEQ ID NO: 26621 - DNA, 20 bp, Artificial Sequence
  Description of Artificial Sequence: Synthetic oligonucleotide
  Target: FXN; (-) strand; PAM type: YTN; PAM sequence: TTT
ttagtagagacggggtttca

SEQ ID NO: 26622 - DNA, 20 bp, Artificial Sequence
  Description of Artificial Sequence: Synthetic oligonucleotide
  Target: FXN; (-) strand; PAM type: YTN; PAM sequence: TTT
tttagtagagacggggtttc

SEQ ID NO: 26623 - DNA, 20 bp, Artificial Sequence
  Description of Artificial Sequence: Synthetic oligonucleotide
  Target: FXN; (-) strand; PAM type: YTN; PAM sequence: TTT
ttttagtagagacggggttt

SEQ ID NO: 26624 - DNA, 20 bp, Artificial Sequence
  Description of Artificial Sequence: Synthetic oligonucleotide
  Target: FXN; (-) strand; PAM type: YTN; PAM sequence: TTG
tatttttttagtagagacgg

SEQ ID NO: 26625 - DNA, 20 bp, Artificial Sequence
  Description of Artificial Sequence: Synthetic oligonucleotide
  Target: FXN; (-) strand; PAM type: YTN; PAM sequence: TTT
gtatttttttagtagagacg

SEQ ID NO: 26626 - DNA, 20 bp, Artificial Sequence
  Description of Artificial Sequence: Synthetic oligonucleotide
  Target: FXN; (-) strand; PAM type: YTN; PAM sequence: TTT
tgtatttttttagtagagac

SEQ ID NO: 26627 - DNA, 20 bp, Artificial Sequence
  Description of Artificial Sequence: Synthetic oligonucleotide
  Target: FXN; (-) strand; PAM type: YTN; PAM sequence: TTT
ttgtatttttttagtagaga

SEQ ID NO: 26628 - DNA, 20 bp, Artificial Sequence
  Description of Artificial Sequence: Synthetic oligonucleotide
  Target: FXN; (-) strand; PAM type: YTN; PAM sequence: TTT
tttgtatttttttagtagag

SEQ ID NO: 26629 - DNA, 20 bp, Artificial Sequence
  Description of Artificial Sequence: Synthetic oligonucleotide
  Target: FXN; (-) strand; PAM type: YTN; PAM sequence: TTT
ttttgtatttttttagtaga

SEQ ID NO: 26630 - DNA, 20 bp, Artificial Sequence
  Description of Artificial Sequence: Synthetic oligonucleotide
  Target: FXN; (-) strand; PAM type: YTN; PAM sequence: CTA
atttttttgtatttttttag

SEQ ID NO: 26631 - DNA, 20 bp, Artificial Sequence
  Description of Artificial Sequence: Synthetic oligonucleotide
  Target: FXN; (-) strand; PAM type: YTN; PAM sequence: CTA
caggcgcccaccaccacgcc

SEQ ID NO: 26632 - DNA, 20 bp, Artificial Sequence
  Description of Artificial Sequence: Synthetic oligonucleotide
  Target: FXN; (-) strand; PAM type: YTN; PAM sequence: CTG
ggactacaggcgcccaccac

SEQ ID NO: 26633 - DNA, 20 bp, Artificial Sequence
  Description of Artificial Sequence: Synthetic oligonucleotide
  Target: FXN; (-) strand; PAM type: YTN; PAM sequence: TTC
ccgagtagctgggactacag

SEQ ID NO: 26634 - DNA, 20 bp, Artificial Sequence
  Description of Artificial Sequence: Synthetic oligonucleotide
  Target: FXN; (-) strand; PAM type: YTN; PAM sequence: CTT
cccgagtagctgggactaca

SEQ ID NO: 26635 - DNA, 20 bp, Artificial Sequence
  Description of Artificial Sequence: Synthetic oligonucleotide
  Target: FXN; (-) strand; PAM type: YTN; PAM sequence: CTC
agcttcccgagtagctggga

SEQ ID NO: 26636 - DNA, 20 bp, Artificial Sequence
  Description of Artificial Sequence: Synthetic oligonucleotide
  Target: FXN; (-) strand; PAM type: YTN; PAM sequence: CTG
cctcagcttcccgagtagct

SEQ ID NO: 26637 - DNA, 20 bp, Artificial Sequence
  Description of Artificial Sequence: Synthetic oligonucleotide
  Target: FXN; (-) strand; PAM type: YTN; PAM sequence: CTC
ctgcctcagcttcccgagta

SEQ ID NO: 26638 - DNA, 20 bp, Artificial Sequence
  Description of Artificial Sequence: Synthetic oligonucleotide
  Target: FXN; (-) strand; PAM type: YTN; PAM sequence: TTC
tcctgcctcagcttcccgag

SEQ ID NO: 26639 - DNA, 20 bp, Artificial Sequence
  Description of Artificial Sequence: Synthetic oligonucleotide
  Target: FXN; (-) strand; PAM type: YTN; PAM sequence: TTC
acgccattctcctgcctcag

SEQ ID NO: 26640 - DNA, 20 bp, Artificial Sequence
  Description of Artificial Sequence: Synthetic oligonucleotide
  Target: FXN; (-) strand; PAM type: YTN; PAM sequence: CTC
ccgggttcacgccattctcc

SEQ ID NO: 26641 - DNA, 20 bp, Artificial Sequence
  Description of Artificial Sequence: Synthetic oligonucleotide
  Target: FXN; (-) strand; PAM type: YTN; PAM sequence: CTG
cctcccgggttcacgccatt

SEQ ID NO: 26642 - DNA, 20 bp, Artificial Sequence
  Description of Artificial Sequence: Synthetic oligonucleotide
  Target: FXN; (-) strand; PAM type: YTN; PAM sequence: CTC
tgcctcccgggttcacgcca

SEQ ID NO: 26643 - DNA, 20 bp, Artificial Sequence
  Description of Artificial Sequence: Synthetic oligonucleotide
  Target: FXN; (-) strand; PAM type: YTN; PAM sequence: CTG
caagctctgcctcccgggtt

SEQ ID NO: 26644 - DNA, 20 bp, Artificial Sequence
  Description of Artificial Sequence: Synthetic oligonucleotide
  Target: FXN; (-) strand; PAM type: YTN; PAM sequence: TTC
actgcaagctctgcctcccg

SEQ ID NO: 26645 - DNA, 20 bp, Artificial Sequence
  Description of Artificial Sequence: Synthetic oligonucleotide
  Target: FXN; (-) strand; PAM type: YTN; PAM sequence: TTG
gttcactgcaagctctgcct

SEQ ID NO: 26646 - DNA, 20 bp, Artificial Sequence
  Description of Artificial Sequence: Synthetic oligonucleotide
  Target: FXN; (-) strand; PAM type: YTN; PAM sequence: CTT
ggttcactgcaagctctgcc

SEQ ID NO: 26647 - DNA, 20 bp, Artificial Sequence
  Description of Artificial Sequence: Synthetic oligonucleotide
  Target: FXN; (-) strand; PAM type: YTN; PAM sequence: CTC
gatcttggttcactgcaagc

SEQ ID NO: 26648 - DNA, 20 bp, Artificial Sequence
  Description of Artificial Sequence: Synthetic oligonucleotide
  Target: FXN; (-) strand; PAM type: YTN; PAM sequence: CTA
gagtgcagtggctcgatctt

SEQ ID NO: 26649 - DNA, 20 bp, Artificial Sequence
  Description of Artificial Sequence: Synthetic oligonucleotide
  Target: FXN; (-) strand; PAM type: YTN; PAM sequence: CTG
tcacccaggctagagtgcag

SEQ ID NO: 26650 - DNA, 20 bp, Artificial Sequence
  Description of Artificial Sequence: Synthetic oligonucleotide
  Target: FXN; (-) strand; PAM type: YTN; PAM sequence: CTC
tgtcacccaggctagagtgc

SEQ ID NO: 26651 - DNA, 20 bp, Artificial Sequence
  Description of Artificial Sequence: Synthetic oligonucleotide
  Target: FXN; (-) strand; PAM type: YTN; PAM sequence: CTC
gctctgtcacccaggctaga

SEQ ID NO: 26652 - DNA, 20 bp, Artificial Sequence
  Description of Artificial Sequence: Synthetic oligonucleotide
  Target: FXN; (-) strand; PAM type: YTN; PAM sequence: TTG
agatggagtctcgctctgtc

SEQ ID NO: 26653 - DNA, 20 bp, Artificial Sequence
  Description of Artificial Sequence: Synthetic oligonucleotide
  Target: FXN; (-) strand; PAM type: YTN; PAM sequence: TTT
gagatggagtctcgctctgt

SEQ ID NO: 26654 - DNA, 20 bp, Artificial Sequence
  Description of Artificial Sequence: Synthetic oligonucleotide
  Target: FXN; (-) strand; PAM type: YTN; PAM sequence: TTT
tgagatggagtctcgctctg

SEQ ID NO: 26655 - DNA, 20 bp, Artificial Sequence
  Description of Artificial Sequence: Synthetic oligonucleotide
  Target: FXN; (-) strand; PAM type: YTN; PAM sequence: TTT
ttgagatggagtctcgctct

SEQ ID NO: 26656 - DNA, 20 bp, Artificial Sequence
  Description of Artificial Sequence: Synthetic oligonucleotide
  Target: FXN; (-) strand; PAM type: YTN; PAM sequence: TTT
tttgagatggagtctcgctc

SEQ ID NO: 26657 - DNA, 20 bp, Artificial Sequence
  Description of Artificial Sequence: Synthetic oligonucleotide
  Target: FXN; (-) strand; PAM type: YTN; PAM sequence: TTT
ttttgagatggagtctcgct

SEQ ID NO: 26658 - DNA, 20 bp, Artificial Sequence
  Description of Artificial Sequence: Synthetic oligonucleotide
  Target: FXN; (-) strand; PAM type: YTN; PAM sequence: TTT
tttttgagatggagtctcgc

SEQ ID NO: 26659 - DNA, 20 bp, Artificial Sequence
  Description of Artificial Sequence: Synthetic oligonucleotide
  Target: FXN; (-) strand; PAM type: YTN; PAM sequence: TTT
ttttttgagatggagtctcg

SEQ ID NO: 26660 - DNA, 20 bp, Artificial Sequence
  Description of Artificial Sequence: Synthetic oligonucleotide
  Target: FXN; (-) strand; PAM type: YTN; PAM sequence: TTT
tttttttgagatggagtctc

SEQ ID NO: 26661 - DNA, 20 bp, Artificial Sequence
  Description of Artificial Sequence: Synthetic oligonucleotide
  Target: FXN; (-) strand; PAM type: YTN; PAM sequence: TTT
ttttttttgagatggagtct

SEQ ID NO: 26662 - DNA, 20 bp, Artificial Sequence
  Description of Artificial Sequence: Synthetic oligonucleotide
  Target: FXN; (-) strand; PAM type: YTN; PAM sequence: TTT
tttttttttgagatggagtc

SEQ ID NO: 26663 - DNA, 20 bp, Artificial Sequence
  Description of Artificial Sequence: Synthetic oligonucleotide
  Target: FXN; (-) strand; PAM type: YTN; PAM sequence: TTT
ttttttttttgagatggagt

SEQ ID NO: 26664 - DNA, 20 bp, Artificial Sequence
  Description of Artificial Sequence: Synthetic oligonucleotide
  Target: FXN; (-) strand; PAM type: YTN; PAM sequence: TTT
tttttttttttgagatggag

SEQ ID NO: 26665 - DNA, 20 bp, Artificial Sequence
  Description of Artificial Sequence: Synthetic oligonucleotide
  Target: FXN; (-) strand; PAM type: YTN; PAM sequence: CTT
ttttttttttttgagatgga

SEQ ID NO: 26666 - DNA, 20 bp, Artificial Sequence
  Description of Artificial Sequence: Synthetic oligonucleotide
  Target: FXN; (-) strand; PAM type: YTN; PAM sequence: CTG
gtgagtcttttttttttttt

SEQ ID NO: 26667 - DNA, 20 bp, Artificial Sequence
  Description of Artificial Sequence: Synthetic oligonucleotide
  Target: FXN; (-) strand; PAM type: YTN; PAM sequence: TTA
gcacagacagtggccacagc

SEQ ID NO: 26668 - DNA, 20 bp, Artificial Sequence
  Description of Artificial Sequence: Synthetic oligonucleotide
  Target: FXN; (-) strand; PAM type: YTN; PAM sequence: CTA
gccaattagcacagacagtg

SEQ ID NO: 26669 - DNA, 20 bp, Artificial Sequence
  Description of Artificial Sequence: Synthetic oligonucleotide
  Target: FXN; (-) strand; PAM type: YTN; PAM sequence: CTG
agatgcaggcactagccaat

SEQ ID NO: 26670 - DNA, 20 bp, Artificial Sequence
  Description of Artificial Sequence: Synthetic oligonucleotide
  Target: FXN; (-) strand; PAM type: YTN; PAM sequence: TTC
tgagatgcaggcactagcca

SEQ ID NO: 26671 - DNA, 20 bp, Artificial Sequence
  Description of Artificial Sequence: Synthetic oligonucleotide
  Target: FXN; (-) strand; PAM type: YTN; PAM sequence: TTT
ctgagatgcaggcactagcc

SEQ ID NO: 26672 - DNA, 20 bp, Artificial Sequence
  Description of Artificial Sequence: Synthetic oligonucleotide
  Target: FXN; (-) strand; PAM type: YTN; PAM sequence: TTA
agtgcagggggaatagtcaa

SEQ ID NO: 26673 - DNA, 20 bp, Artificial Sequence
  Description of Artificial Sequence: Synthetic oligonucleotide
  Target: FXN; (-) strand; PAM type: YTN; PAM sequence: CTT
aagtgcagggggaatagtca

SEQ ID NO: 26674 - DNA, 20 bp, Artificial Sequence
  Description of Artificial Sequence: Synthetic oligonucleotide
  Target: FXN; (-) strand; PAM type: YTN; PAM sequence: TTG
ggagtgtgcatgcccttaag

SEQ ID NO: 26675 - DNA, 20 bp, Artificial Sequence
  Description of Artificial Sequence: Synthetic oligonucleotide
  Target: FXN; (-) strand; PAM type: YTN; PAM sequence: TTT
gggagtgtgcatgcccttaa

SEQ ID NO: 26676 - DNA, 20 bp, Artificial Sequence
  Description of Artificial Sequence: Synthetic oligonucleotide
  Target: FXN; (-) strand; PAM type: YTN; PAM sequence: TTT
tgggagtgtgcatgccctta

SEQ ID NO: 26677 - DNA, 20 bp, Artificial Sequence
  Description of Artificial Sequence: Synthetic oligonucleotide
  Target: FXN; (-) strand; PAM type: YTN; PAM sequence: CTA
ttttgggagtgtgcatgccc

SEQ ID NO: 26678 - DNA, 20 bp, Artificial Sequence
  Description of Artificial Sequence: Synthetic oligonucleotide
  Target: FXN; (-) strand; PAM type: YTN; PAM sequence: CTG
agtctattttgggagtgtgc

SEQ ID NO: 26679 - DNA, 20 bp, Artificial Sequence
  Description of Artificial Sequence: Synthetic oligonucleotide
  Target: FXN; (-) strand; PAM type: YTN; PAM sequence: TTA
gacaatctgagtctattttg

SEQ ID NO: 26680 - DNA, 20 bp, Artificial Sequence
  Description of Artificial Sequence: Synthetic oligonucleotide
  Target: FXN; (-) strand; PAM type: YTN; PAM sequence: CTT
agacaatctgagtctatttt

SEQ ID NO: 26681 - DNA, 20 bp, Artificial Sequence
  Description of Artificial Sequence: Synthetic oligonucleotide
  Target: FXN; (-) strand; PAM type: YTN; PAM sequence: TTC
cttagacaatctgagtctat

SEQ ID NO: 26682 - DNA, 20 bp, Artificial Sequence
  Description of Artificial Sequence: Synthetic oligonucleotide
  Target: FXN; (-) strand; PAM type: YTN; PAM sequence: TTA
ttccttagacaatctgagtc

SEQ ID NO: 26683 - DNA, 20 bp, Artificial Sequence
  Description of Artificial Sequence: Synthetic oligonucleotide
  Target: FXN; (-) strand; PAM type: YTN; PAM sequence: TTC
atcatcatcattattcctta

SEQ ID NO: 26684 - DNA, 20 bp, Artificial Sequence
  Description of Artificial Sequence: Synthetic oligonucleotide
  Target: FXN; (-) strand; PAM type: YTN; PAM sequence: CTT
catcatcatcattattcctt

SEQ ID NO: 26685 - DNA, 20 bp, Artificial Sequence
  Description of Artificial Sequence: Synthetic oligonucleotide
  Target: FXN; (-) strand; PAM type: YTN; PAM sequence: CTC
ttcatcatcatcattattcc

SEQ ID NO: 26686 - DNA, 20 bp, Artificial Sequence
  Description of Artificial Sequence: Synthetic oligonucleotide
  Target: FXN; (-) strand; PAM type: YTN; PAM sequence: TTC
tcttcatcatcatcattatt

SEQ ID NO: 26687 - DNA, 20 bp, Artificial Sequence
  Description of Artificial Sequence: Synthetic oligonucleotide
  Target: FXN; (-) strand; PAM type: YTN; PAM sequence: TTT
ctcttcatcatcatcattat

SEQ ID NO: 26688 - DNA, 20 bp, Artificial Sequence
  Description of Artificial Sequence: Synthetic oligonucleotide
  Target: FXN; (-) strand; PAM type: YTN; PAM sequence: CTT
tctcttcatcatcatcatta

SEQ ID NO: 26689 - DNA, 20 bp, Artificial Sequence
  Description of Artificial Sequence: Synthetic oligonucleotide
  Target: FXN; (-) strand; PAM type: YTN; PAM sequence: CTA
caaatagaccagataaagag

SEQ ID NO: 26690 - DNA, 20 bp, Artificial Sequence
  Description of Artificial Sequence: Synthetic oligonucleotide
  Target: FXN; (-) strand; PAM type: YTN; PAM sequence: CTG
actacaaatagaccagataa

SEQ ID NO: 26691 - DNA, 20 bp, Artificial Sequence
  Description of Artificial Sequence: Synthetic oligonucleotide
  Target: FXN; (-) strand; PAM type: YTN; PAM sequence: TTG
gaactgactacaaatagacc

SEQ ID NO: 26692 - DNA, 20 bp, Artificial Sequence
  Description of Artificial Sequence: Synthetic oligonucleotide
  Target: FXN; (-) strand; PAM type: YTN; PAM sequence: TTT
ggaactgactacaaatagac

SEQ ID NO: 26693 - DNA, 20 bp, Artificial Sequence
  Description of Artificial Sequence: Synthetic oligonucleotide
  Target: FXN; (-) strand; PAM type: YTN; PAM sequence: TTT
tggaactgactacaaataga

SEQ ID NO: 26694 - DNA, 20 bp, Artificial Sequence
  Description of Artificial Sequence: Synthetic oligonucleotide
  Target: FXN; (-) strand; PAM type: YTN; PAM sequence: CTT
ttggaactgactacaaatag

SEQ ID NO: 26695 - DNA, 20 bp, Artificial Sequence
  Description of Artificial Sequence: Synthetic oligonucleotide
  Target: FXN; (-) strand; PAM type: YTN; PAM sequence: TTA
atgcttttggaactgactac

SEQ ID NO: 26696 - DNA, 20 bp, Artificial Sequence
  Description of Artificial Sequence: Synthetic oligonucleotide
  Target: FXN; (-) strand; PAM type: YTN; PAM sequence: CTT
aatgcttttggaactgacta

SEQ ID NO: 26697 - DNA, 20 bp, Artificial Sequence
  Description of Artificial Sequence: Synthetic oligonucleotide
  Target: FXN; (-) strand; PAM type: YTN; PAM sequence: TTC
ttaatgcttttggaactgac

SEQ ID NO: 26698 - DNA, 20 bp, Artificial Sequence
  Description of Artificial Sequence: Synthetic oligonucleotide
  Target: FXN; (-) strand; PAM type: YTN; PAM sequence: TTC
agcagaaattcttaatgctt

SEQ ID NO: 26699 - DNA, 20 bp, Artificial Sequence
  Description of Artificial Sequence: Synthetic oligonucleotide
  Target: FXN; (-) strand; PAM type: YTN; PAM sequence: TTA
gttcagcagaaattcttaat

SEQ ID NO: 26700 - DNA, 20 bp, Artificial Sequence
  Description of Artificial Sequence: Synthetic oligonucleotide
  Target: FXN; (-) strand; PAM type: YTN; PAM sequence: CTG
cattagttcagcagaaattc

SEQ ID NO: 26701 - DNA, 20 bp, Artificial Sequence
  Description of Artificial Sequence: Synthetic oligonucleotide
  Target: FXN; (-) strand; PAM type: YTN; PAM sequence: CTA
gctgcattagttcagcagaa

SEQ ID NO: 26702 - DNA, 20 bp, Artificial Sequence
  Description of Artificial Sequence: Synthetic oligonucleotide
  Target: FXN; (-) strand; PAM type: YTN; PAM sequence: TTG
gaaggaaagtggtgacagga

SEQ ID NO: 26703 - DNA, 20 bp, Artificial Sequence
  Description of Artificial Sequence: Synthetic oligonucleotide
  Target: FXN; (-) strand; PAM type: YTN; PAM sequence: TTT
ggaaggaaagtggtgacagg

SEQ ID NO: 26704 - DNA, 20 bp, Artificial Sequence
  Description of Artificial Sequence: Synthetic oligonucleotide
  Target: FXN; (-) strand; PAM type: YTN; PAM sequence: TTT
tggaaggaaagtggtgacag

SEQ ID NO: 26705 - DNA, 20 bp, Artificial Sequence
  Description of Artificial Sequence: Synthetic oligonucleotide
  Target: FXN; (-) strand; PAM type: YTN; PAM sequence: CTA
ttttggaaggaaagtggtga

SEQ ID NO: 26706 - DNA, 20 bp, Artificial Sequence
  Description of Artificial Sequence: Synthetic oligonucleotide
  Target: FXN; (-) strand; PAM type: YTN; PAM sequence: TTG
aaactattttggaaggaaag

SEQ ID NO: 26707 - DNA, 20 bp, Artificial Sequence
  Description of Artificial Sequence: Synthetic oligonucleotide
  Target: FXN; (-) strand; PAM type: YTN; PAM sequence: CTT
gaaactattttggaaggaaa

SEQ ID NO: 26708 - DNA, 20 bp, Artificial Sequence
  Description of Artificial Sequence: Synthetic oligonucleotide
  Target: FXN; (-) strand; PAM type: YTN; PAM sequence: TTC
ccccacagatcttgaaacta

SEQ ID NO: 26709 - DNA, 20 bp, Artificial Sequence
  Description of Artificial Sequence: Synthetic oligonucleotide
  Target: FXN; (-) strand; PAM type: YTN; PAM sequence: TTT
cccccacagatcttgaaact

SEQ ID NO: 26710 - DNA, 20 bp, Artificial Sequence
  Description of Artificial Sequence: Synthetic oligonucleotide
  Target: FXN; (-) strand; PAM type: YTN; PAM sequence: TTT
tcccccacagatcttgaaac

SEQ ID NO: 26711 - DNA, 20 bp, Artificial Sequence
  Description of Artificial Sequence: Synthetic oligonucleotide
  Target: FXN; (-) strand; PAM type: YTN; PAM sequence: TTT
ttcccccacagatcttgaaa

SEQ ID NO: 26712 - DNA, 20 bp, Artificial Sequence
  Description of Artificial Sequence: Synthetic oligonucleotide
  Target: FXN; (-) strand; PAM type: YTN; PAM sequence: TTT
tttcccccacagatcttgaa

SEQ ID NO: 26713 - DNA, 20 bp, Artificial Sequence
  Description of Artificial Sequence: Synthetic oligonucleotide
  Target: FXN; (-) strand; PAM type: YTN; PAM sequence: CTG
taaatagattttttccccca

SEQ ID NO: 26714 - DNA, 20 bp, Artificial Sequence
  Description of Artificial Sequence: Synthetic oligonucleotide
  Target: FXN; (-) strand; PAM type: YTN; PAM sequence: TTC
actgtaaatagattttttcc

SEQ ID NO: 26715 - DNA, 20 bp, Artificial Sequence
  Description of Artificial Sequence: Synthetic oligonucleotide
  Target: FXN; (-) strand; PAM type: YTN; PAM sequence: CTG
ttcactgtaaatagattttt

SEQ ID NO: 26716 - DNA, 20 bp, Artificial Sequence
  Description of Artificial Sequence: Synthetic oligonucleotide
  Target: FXN; (-) strand; PAM type: YTN; PAM sequence: CTC
ccaccagtctgttcactgta

SEQ ID NO: 26717 - DNA, 20 bp, Artificial Sequence
  Description of Artificial Sequence: Synthetic oligonucleotide
  Target: FXN; (-) strand; PAM type: YTN; PAM sequence: TTC
ctcccaccagtctgttcact

SEQ ID NO: 26718 - DNA, 20 bp, Artificial Sequence
  Description of Artificial Sequence: Synthetic oligonucleotide
  Target: FXN; (-) strand; PAM type: YTN; PAM sequence: CTT
cctcccaccagtctgttcac

SEQ ID NO: 26719 - DNA, 20 bp, Artificial Sequence
  Description of Artificial Sequence: Synthetic oligonucleotide
  Target: FXN; (-) strand; PAM type: YTN; PAM sequence: CTC
aacttcctcccaccagtctg

SEQ ID NO: 26720 - DNA, 20 bp, Artificial Sequence
  Description of Artificial Sequence: Synthetic oligonucleotide
  Target: FXN; (-) strand; PAM type: YTN; PAM sequence: TTA
cacagggcagaaaaccccaa

SEQ ID NO: 26721 - DNA, 20 bp, Artificial Sequence
  Description of Artificial Sequence: Synthetic oligonucleotide
  Target: FXN; (-) strand; PAM type: YTN; PAM sequence: TTA
gggcaaggttacacagggca

SEQ ID NO: 26722 - DNA, 20 bp, Artificial Sequence
  Description of Artificial Sequence: Synthetic oligonucleotide
  Target: FXN; (-) strand; PAM type: YTN; PAM sequence: CTT
agggcaaggttacacagggc

SEQ ID NO: 26723 - DNA, 20 bp, Artificial Sequence
  Description of Artificial Sequence: Synthetic oligonucleotide
  Target: FXN; (-) strand; PAM type: YTN; PAM sequence: CTG
cccaacttagggcaaggtta

SEQ ID NO: 26724 - DNA, 20 bp, Artificial Sequence
  Description of Artificial Sequence: Synthetic oligonucleotide
  Target: FXN; (-) strand; PAM type: YTN; PAM sequence: CTG
gtcaaatagtgaatgagcag

SEQ ID NO: 26725 - DNA, 20 bp, Artificial Sequence
  Description of Artificial Sequence: Synthetic oligonucleotide
  Target: FXN; (-) strand; PAM type: YTN; PAM sequence: TTG
tgaatgaatgaccaactggt

SEQ ID NO: 26726 - DNA, 20 bp, Artificial Sequence
  Description of Artificial Sequence: Synthetic oligonucleotide
  Target: FXN; (-) strand; PAM type: YTN; PAM sequence: TTT
gtgaatgaatgaccaactgg

SEQ ID NO: 26727 - DNA, 20 bp, Artificial Sequence
  Description of Artificial Sequence: Synthetic oligonucleotide
  Target: FXN; (-) strand; PAM type: YTN; PAM sequence: CTG
caaaaaggacatttgtgaat

SEQ ID NO: 26728 - DNA, 20 bp, Artificial Sequence
  Description of Artificial Sequence: Synthetic oligonucleotide
  Target: FXN; (-) strand; PAM type: YTN; PAM sequence: CTC
ctgcaaaaaggacatttgtg

SEQ ID NO: 26729 - DNA, 20 bp, Artificial Sequence
  Description of Artificial Sequence: Synthetic oligonucleotide
  Target: FXN; (-) strand; PAM type: YTN; PAM sequence: CTC
catccctcctgcaaaaagga

SEQ ID NO: 26730 - DNA, 20 bp, Artificial Sequence
  Description of Artificial Sequence: Synthetic oligonucleotide
  Target: FXN; (-) strand; PAM type: YTN; PAM sequence: CTA
gcacctccatccctcctgca

SEQ ID NO: 26731 - DNA, 20 bp, Artificial Sequence
  Description of Artificial Sequence: Synthetic oligonucleotide
  Target: FXN; (-) strand; PAM type: YTN; PAM sequence: CTG
caggtctagcacctccatcc

SEQ ID NO: 26732 - DNA, 20 bp, Artificial Sequence
  Description of Artificial Sequence: Synthetic oligonucleotide
  Target: FXN; (-) strand; PAM type: YTN; PAM sequence: CTA
gcatctgcaggtctagcacc

SEQ ID NO: 26733 - DNA, 20 bp, Artificial Sequence
  Description of Artificial Sequence: Synthetic oligonucleotide
  Target: FXN; (-) strand; PAM type: YTN; PAM sequence: TTC
atgctagcatctgcaggtct

SEQ ID NO: 26734 - DNA, 20 bp, Artificial Sequence
  Description of Artificial Sequence: Synthetic oligonucleotide
  Target: FXN; (-) strand; PAM type: YTN; PAM sequence: TTT
catgctagcatctgcaggtc

SEQ ID NO: 26735 - DNA, 20 bp, Artificial Sequence
  Description of Artificial Sequence: Synthetic oligonucleotide
  Target: FXN; (-) strand; PAM type: YTN; PAM sequence: TTT
tcatgctagcatctgcaggt

SEQ ID NO: 26736 - DNA, 20 bp, Artificial Sequence
  Description of Artificial Sequence: Synthetic oligonucleotide
  Target: FXN; (-) strand; PAM type: YTN; PAM sequence: CTT
ttcatgctagcatctgcagg

SEQ ID NO: 26737 - DNA, 20 bp, Artificial Sequence
  Description of Artificial Sequence: Synthetic oligonucleotide
  Target: FXN; (-) strand; PAM type: YTN; PAM sequence: CTG
tcttttcatgctagcatctg

SEQ ID NO: 26738 - DNA, 20 bp, Artificial Sequence
  Description of Artificial Sequence: Synthetic oligonucleotide
  Target: FXN; (-) strand; PAM type: YTN; PAM sequence: TTA
gcagcaggagatctgtcttt

SEQ ID NO: 26739 - DNA, 20 bp, Artificial Sequence
  Description of Artificial Sequence: Synthetic oligonucleotide
  Target: FXN; (-) strand; PAM type: YTN; PAM sequence: CTT
agcagcaggagatctgtctt

SEQ ID NO: 26740 - DNA, 20 bp, Artificial Sequence
  Description of Artificial Sequence: Synthetic oligonucleotide
  Target: FXN; (-) strand; PAM type: YTN; PAM sequence: TTA
agcaccttagcagcaggaga

SEQ ID NO: 26741 - DNA, 20 bp, Artificial Sequence
  Description of Artificial Sequence: Synthetic oligonucleotide
  Target: FXN; (-) strand; PAM type: YTN; PAM sequence: TTT
aagcaccttagcagcaggag

SEQ ID NO: 26742 - DNA, 20 bp, Artificial Sequence
  Description of Artificial Sequence: Synthetic oligonucleotide
  Target: FXN; (-) strand; PAM type: YTN; PAM sequence: CTT
taagcaccttagcagcagga

SEQ ID NO: 26743 - DNA, 20 bp, Artificial Sequence
  Description of Artificial Sequence: Synthetic oligonucleotide
  Target: FXN; (-) strand; PAM type: YTN; PAM sequence: CTA
ctttaagcaccttagcagca

SEQ ID NO: 26744 - DNA, 20 bp, Artificial Sequence
  Description of Artificial Sequence: Synthetic oligonucleotide
  Target: FXN; (-) strand; PAM type: YTN; PAM sequence: CTC
cactactttaagcaccttag

SEQ ID NO: 26745 - DNA, 20 bp, Artificial Sequence
  Description of Artificial Sequence: Synthetic oligonucleotide
  Target: FXN; (-) strand; PAM type: YTN; PAM sequence: CTG
acctccactactttaagcac

SEQ ID NO: 26746 - DNA, 20 bp, Artificial Sequence
  Description of Artificial Sequence: Synthetic oligonucleotide
  Target: FXN; (-) strand; PAM type: YTN; PAM sequence: TTG
tcccctgacctccactactt

SEQ ID NO: 26747 - DNA, 20 bp, Artificial Sequence
  Description of Artificial Sequence: Synthetic oligonucleotide
  Target: FXN; (-) strand; PAM type: YTN; PAM sequence: CTT
gtcccctgacctccactact

SEQ ID NO: 26748 - DNA, 20 bp, Artificial Sequence
  Description of Artificial Sequence: Synthetic oligonucleotide
  Target: FXN; (-) strand; PAM type: YTN; PAM sequence: TTG
cttgtcccctgacctccact

SEQ ID NO: 26749 - DNA, 20 bp, Artificial Sequence
  Description of Artificial Sequence: Synthetic oligonucleotide
  Target: FXN; (-) strand; PAM type: YTN; PAM sequence: CTT
gcttgtcccctgacctccac

SEQ ID NO: 26750 - DNA, 20 bp, Artificial Sequence
  Description of Artificial Sequence: Synthetic oligonucleotide
  Target: FXN; (-) strand; PAM type: YTN; PAM sequence: CTG
cttgcttgtcccctgacctc

SEQ ID NO: 26751 - DNA, 20 bp, Artificial Sequence
  Description of Artificial Sequence: Synthetic oligonucleotide
  Target: FXN; (-) strand; PAM type: YTN; PAM sequence: CTG
actgcttgcttgtcccctga

SEQ ID NO: 26752 - DNA, 20 bp, Artificial Sequence
  Description of Artificial Sequence: Synthetic oligonucleotide
  Target: FXN; (-) strand; PAM type: YTN; PAM sequence: CTG
cctgactgcttgcttgtccc

SEQ ID NO: 26753 - DNA, 20 bp, Artificial Sequence
  Description of Artificial Sequence: Synthetic oligonucleotide
  Target: FXN; (-) strand; PAM type: YTN; PAM sequence: TTC
agagctgcctgactgcttgc

SEQ ID NO: 26754 - DNA, 20 bp, Artificial Sequence
  Description of Artificial Sequence: Synthetic oligonucleotide
  Target: FXN; (-) strand; PAM type: YTN; PAM sequence: CTG
cattcagagctgcctgactg

SEQ ID NO: 26755 - DNA, 20 bp, Artificial Sequence
  Description of Artificial Sequence: Synthetic oligonucleotide
  Target: FXN; (-) strand; PAM type: YTN; PAM sequence: CTC
tgcattcagagctgcctgac

SEQ ID NO: 26756 - DNA, 20 bp, Artificial Sequence
  Description of Artificial Sequence: Synthetic oligonucleotide
  Target: FXN; (-) strand; PAM type: YTN; PAM sequence: CTG
cctctgcattcagagctgcc

SEQ ID NO: 26757 - DNA, 20 bp, Artificial Sequence
  Description of Artificial Sequence: Synthetic oligonucleotide
  Target: FXN; (-) strand; PAM type: YTN; PAM sequence: TTC
ctgcctctgcattcagagct

SEQ ID NO: 26758 - DNA, 20 bp, Artificial Sequence
  Description of Artificial Sequence: Synthetic oligonucleotide
  Target: FXN; (-) strand; PAM type: YTN; PAM sequence: CTT
cctgcctctgcattcagagc

SEQ ID NO: 26759 - DNA, 20 bp, Artificial Sequence
  Description of Artificial Sequence: Synthetic oligonucleotide
  Target: FXN; (-) strand; PAM type: YTN; PAM sequence: CTC
gtggtgcttcctgcctctgc

SEQ ID NO: 26760 - DNA, 20 bp, Artificial Sequence
  Description of Artificial Sequence: Synthetic oligonucleotide
  Target: FXN; (-) strand; PAM type: YTN; PAM sequence: TTG
cctcgtggtgcttcctgcct

SEQ ID NO: 26761 - DNA, 20 bp, Artificial Sequence
  Description of Artificial Sequence: Synthetic oligonucleotide
  Target: FXN; (-) strand; PAM type: YTN; PAM sequence: CTG
tgggtcccattgcctcgtgg

SEQ ID NO: 26762 - DNA, 20 bp, Artificial Sequence
  Description of Artificial Sequence: Synthetic oligonucleotide
  Target: FXN; (-) strand; PAM type: YTN; PAM sequence: CTC
tgtgggtcccattgcctcgt

SEQ ID NO: 26763 - DNA, 20 bp, Artificial Sequence
  Description of Artificial Sequence: Synthetic oligonucleotide
  Target: FXN; (-) strand; PAM type: YTN; PAM sequence: CTA
cccctctgtgggtcccattg

SEQ ID NO: 26764 - DNA, 20 bp, Artificial Sequence
  Description of Artificial Sequence: Synthetic oligonucleotide
  Target: FXN; (-) strand; PAM type: YTN; PAM sequence: CTG
ctacccctctgtgggtccca

SEQ ID NO: 26765 - DNA, 20 bp, Artificial Sequence
  Description of Artificial Sequence: Synthetic oligonucleotide
  Target: FXN; (-) strand; PAM type: YTN; PAM sequence: CTA
ccctgctacccctctgtggg

SEQ ID NO: 26766 - DNA, 20 bp, Artificial Sequence
  Description of Artificial Sequence: Synthetic oligonucleotide
  Target: FXN; (-) strand; PAM type: YTN; PAM sequence: CTC
taccctgctacccctctgtg

SEQ ID NO: 26767 - DNA, 20 bp, Artificial Sequence
  Description of Artificial Sequence: Synthetic oligonucleotide
  Target: FXN; (-) strand; PAM type: YTN; PAM sequence: CTC
acctctaccctgctacccct

SEQ ID NO: 26768 - DNA, 20 bp, Artificial Sequence
  Description of Artificial Sequence: Synthetic oligonucleotide
  Target: FXN; (-) strand; PAM type: YTN; PAM sequence: CTC
cccacatgagacccactcac

SEQ ID NO: 26769 - DNA, 20 bp, Artificial Sequence
  Description of Artificial Sequence: Synthetic oligonucleotide
  Target: FXN; (-) strand; PAM type: YTN; PAM sequence: CTC
cctccccacatgagacccac

SEQ ID NO: 26770 - DNA, 20 bp, Artificial Sequence
  Description of Artificial Sequence: Synthetic oligonucleotide
  Target: FXN; (-) strand; PAM type: YTN; PAM sequence: TTC
ctccctccccacatgagacc

SEQ ID NO: 26771 - DNA, 20 bp, Artificial Sequence
  Description of Artificial Sequence: Synthetic oligonucleotide
  Target: FXN; (-) strand; PAM type: YTN; PAM sequence: CTT
cctccctccccacatgagac

SEQ ID NO: 26772 - DNA, 20 bp, Artificial Sequence
  Description of Artificial Sequence: Synthetic oligonucleotide
  Target: FXN; (-) strand; PAM type: YTN; PAM sequence: CTG
cagtcaacttcctccctccc

SEQ ID NO: 26773 - DNA, 20 bp, Artificial Sequence
  Description of Artificial Sequence: Synthetic oligonucleotide
  Target: FXN; (-) strand; PAM type: YTN; PAM sequence: CTC
tgcagtcaacttcctccctc

SEQ ID NO: 26774 - DNA, 20 bp, Artificial Sequence
  Description of Artificial Sequence: Synthetic oligonucleotide
  Target: FXN; (-) strand; PAM type: YTN; PAM sequence: TTC
tctgcagtcaacttcctccc

SEQ ID NO: 26775 - DNA, 20 bp, Artificial Sequence
  Description of Artificial Sequence: Synthetic oligonucleotide
  Target: FXN; (-) strand; PAM type: YTN; PAM sequence: CTT
ctctgcagtcaacttcctcc

SEQ ID NO: 26776 - DNA, 20 bp, Artificial Sequence
  Description of Artificial Sequence: Synthetic oligonucleotide
  Target: FXN; (-) strand; PAM type: YTN; PAM sequence: CTG
gcaccttctctgcagtcaac

SEQ ID NO: 26777 - DNA, 20 bp, Artificial Sequence
  Description of Artificial Sequence: Synthetic oligonucleotide
  Target: FXN; (-) strand; PAM type: YTN; PAM sequence: TTC
accccctggcaccttctctg

SEQ ID NO: 26778 - DNA, 20 bp, Artificial Sequence
  Description of Artificial Sequence: Synthetic oligonucleotide
  Target: FXN; (-) strand; PAM type: YTN; PAM sequence: TTT
caccccctggcaccttctct

SEQ ID NO: 26779 - DNA, 20 bp, Artificial Sequence
  Description of Artificial Sequence: Synthetic oligonucleotide
  Target: FXN; (-) strand; PAM type: YTN; PAM sequence: TTT
tcaccccctggcaccttctc

SEQ ID NO: 26780 - DNA, 20 bp, Artificial Sequence
  Description of Artificial Sequence: Synthetic oligonucleotide
  Target: FXN; (-) strand; PAM type: YTN; PAM sequence: CTA
ttttcaccccctggcacctt

SEQ ID NO: 26781 - DNA, 20 bp, Artificial Sequence
  Description of Artificial Sequence: Synthetic oligonucleotide
  Target: FXN; (-) strand; PAM type: YTN; PAM sequence: CTC
aagctattttcaccccctgg

SEQ ID NO: 26782 - DNA, 20 bp, Artificial Sequence
  Description of Artificial Sequence: Synthetic oligonucleotide
  Target: FXN; (-) strand; PAM type: YTN; PAM sequence: CTC
tcaagctattttcaccccct

SEQ ID NO: 26783 - DNA, 20 bp, Artificial Sequence
  Description of Artificial Sequence: Synthetic oligonucleotide
  Target: FXN; (-) strand; PAM type: YTN; PAM sequence: CTC
cacagctctcaagctatttt

SEQ ID NO: 26784 - DNA, 20 bp, Artificial Sequence
  Description of Artificial Sequence: Synthetic oligonucleotide
  Target: FXN; (-) strand; PAM type: YTN; PAM sequence: CTA
gctccacagctctcaagcta

SEQ ID NO: 26785 - DNA, 20 bp, Artificial Sequence
  Description of Artificial Sequence: Synthetic oligonucleotide
  Target: FXN; (-) strand; PAM type: YTN; PAM sequence: TTC
tagctccacagctctcaagc

SEQ ID NO: 26786 - DNA, 20 bp, Artificial Sequence
  Description of Artificial Sequence: Synthetic oligonucleotide
  Target: FXN; (-) strand; PAM type: YTN; PAM sequence: CTT
ctagctccacagctctcaag

SEQ ID NO: 26787 - DNA, 20 bp, Artificial Sequence
  Description of Artificial Sequence: Synthetic oligonucleotide
  Target: FXN; (-) strand; PAM type: YTN; PAM sequence: TTA
ataagcaaatgtgagagccc

SEQ ID NO: 26788 - DNA, 20 bp, Artificial Sequence
  Description of Artificial Sequence: Synthetic oligonucleotide
  Target: FXN; (-) strand; PAM type: YTN; PAM sequence: TTC
aaagggcatattaataagca

SEQ ID NO: 26789 - DNA, 20 bp, Artificial Sequence
  Description of Artificial Sequence: Synthetic oligonucleotide
  Target: FXN; (-) strand; PAM type: YTN; PAM sequence: TTT
caaagggcatattaataagc

SEQ ID NO: 26790 - DNA, 20 bp, Artificial Sequence
  Description of Artificial Sequence: Synthetic oligonucleotide
  Target: FXN; (-) strand; PAM type: YTN; PAM sequence: TTT
tcaaagggcatattaataag

SEQ ID NO: 26791 - DNA, 20 bp, Artificial Sequence
  Description of Artificial Sequence: Synthetic oligonucleotide
  Target: FXN; (-) strand; PAM type: YTN; PAM sequence: TTT
ttcaaagggcatattaataa

SEQ ID NO: 26792 - DNA, 20 bp, Artificial Sequence
  Description of Artificial Sequence: Synthetic oligonucleotide
  Target: FXN; (-) strand; PAM type: YTN; PAM sequence: CTT
tttcaaagggcatattaata

SEQ ID NO: 26793 - DNA, 20 bp, Artificial Sequence
  Description of Artificial Sequence: Synthetic oligonucleotide
  Target: FXN; (-) strand; PAM type: YTN; PAM sequence: CTC
tttttcaaagggcatattaa

SEQ ID NO: 26794 - DNA, 20 bp, Artificial Sequence
  Description of Artificial Sequence: Synthetic oligonucleotide
  Target: FXN; (-) strand; PAM type: YTN; PAM sequence: CTC
caggtatcaggccactcttt

SEQ ID NO: 26795 - DNA, 20 bp, Artificial Sequence
  Description of Artificial Sequence: Synthetic oligonucleotide
  Target: FXN; (-) strand; PAM type: YTN; PAM sequence: TTG
agtgactccaggtatcaggc

SEQ ID NO: 26796 - DNA, 20 bp, Artificial Sequence
  Description of Artificial Sequence: Synthetic oligonucleotide
  Target: FXN; (-) strand; PAM type: YTN; PAM sequence: TTT
gagtgactccaggtatcagg

SEQ ID NO: 26797 - DNA, 20 bp, Artificial Sequence
  Description of Artificial Sequence: Synthetic oligonucleotide
  Target: FXN; (-) strand; PAM type: YTN; PAM sequence: TTT
tgagtgactccaggtatcag

SEQ ID NO: 26798 - DNA, 20 bp, Artificial Sequence
  Description of Artificial Sequence: Synthetic oligonucleotide
  Target: FXN; (-) strand; PAM type: YTN; PAM sequence: CTT
ttgagtgactccaggtatca

SEQ ID NO: 26799 - DNA, 20 bp, Artificial Sequence
  Description of Artificial Sequence: Synthetic oligonucleotide
  Target: FXN; (-) strand; PAM type: YTN; PAM sequence: TTG
gaaatcttttgagtgactcc

SEQ ID NO: 26800 - DNA, 20 bp, Artificial Sequence
  Description of Artificial Sequence: Synthetic oligonucleotide
  Target: FXN; (-) strand; PAM type: YTN; PAM sequence: CTA
tcggaattggaaatcttttg

SEQ ID NO: 26801 - DNA, 20 bp, Artificial Sequence
  Description of Artificial Sequence: Synthetic oligonucleotide
  Target: FXN; (-) strand; PAM type: YTN; PAM sequence: TTC
ctatcggaattggaaatctt

SEQ ID NO: 26802 - DNA, 20 bp, Artificial Sequence
  Description of Artificial Sequence: Synthetic oligonucleotide
  Target: FXN; (-) strand; PAM type: YTN; PAM sequence: TTT
cctatcggaattggaaatct

SEQ ID NO: 26803 - DNA, 20 bp, Artificial Sequence
  Description of Artificial Sequence: Synthetic oligonucleotide
  Target: FXN; (-) strand; PAM type: YTN; PAM sequence: TTT
tcctatcggaattggaaatc

SEQ ID NO: 26804 - DNA, 20 bp, Artificial Sequence
  Description of Artificial Sequence: Synthetic oligonucleotide
  Target: FXN; (-) strand; PAM type: YTN; PAM sequence: TTT
ttcctatcggaattggaaat

SEQ ID NO: 26805 - DNA, 20 bp, Artificial Sequence
  Description of Artificial Sequence: Synthetic oligonucleotide
  Target: FXN; (-) strand; PAM type: YTN; PAM sequence: CTT
tttcctatcggaattggaaa

SEQ ID NO: 26806 - DNA, 20 bp, Artificial Sequence
  Description of Artificial Sequence: Synthetic oligonucleotide
  Target: FXN; (-) strand; PAM type: YTN; PAM sequence: TTG
actttttcctatcggaattg

SEQ ID NO: 26807 - DNA, 20 bp, Artificial Sequence
  Description of Artificial Sequence: Synthetic oligonucleotide
  Target: FXN; (-) strand; PAM type: YTN; PAM sequence: CTG
aagccaaaattgactttttc

SEQ ID NO: 26808 - DNA, 20 bp, Artificial Sequence
  Description of Artificial Sequence: Synthetic oligonucleotide
  Target: FXN; (-) strand; PAM type: YTN; PAM sequence: CTC
agcatacagcaaatcagggg

SEQ ID NO: 26809 - DNA, 20 bp, Artificial Sequence
  Description of Artificial Sequence: Synthetic oligonucleotide
  Target: FXN; (-) strand; PAM type: YTN; PAM sequence: TTG
cgtccatcaccacaatgcct

SEQ ID NO: 26810 - DNA, 20 bp, Artificial Sequence
  Description of Artificial Sequence: Synthetic oligonucleotide
  Target: FXN; (-) strand; PAM type: YTN; PAM sequence: CTT
gcgtccatcaccacaatgcc

SEQ ID NO: 26811 - DNA, 20 bp, Artificial Sequence
  Description of Artificial Sequence: Synthetic oligonucleotide
  Target: FXN; (-) strand; PAM type: YTN; PAM sequence: CTC
cgcacttgcgtccatcacca

SEQ ID NO: 26812 - DNA, 20 bp, Artificial Sequence
  Description of Artificial Sequence: Synthetic oligonucleotide
  Target: FXN; (-) strand; PAM type: YTN; PAM sequence: CTC
aaggtctccgcacttgcgtc

SEQ ID NO: 26813 - DNA, 20 bp, Artificial Sequence
  Description of Artificial Sequence: Synthetic oligonucleotide
  Target: FXN; (-) strand; PAM type: YTN; PAM sequence: CTA
ggggcagatgcgtgctcaag

SEQ ID NO: 26814 - DNA, 20 bp, Artificial Sequence
  Description of Artificial Sequence: Synthetic oligonucleotide
  Target: FXN; (-) strand; PAM type: YTN; PAM sequence: CTC
agggcaagaactaggggcag

SEQ ID NO: 26815 - DNA, 20 bp, Artificial Sequence
  Description of Artificial Sequence: Synthetic oligonucleotide
  Target: FXN; (-) strand; PAM type: YTN; PAM sequence: TTC
gaggactcagggcaagaact

SEQ ID NO: 26816 - DNA, 20 bp, Artificial Sequence
  Description of Artificial Sequence: Synthetic oligonucleotide
  Target: FXN; (-) strand; PAM type: YTN; PAM sequence: CTT
cgaggactcagggcaagaac

SEQ ID NO: 26817 - DNA, 20 bp, Artificial Sequence
  Description of Artificial Sequence: Synthetic oligonucleotide
  Target: FXN; (-) strand; PAM type: YTN; PAM sequence: CTC
cttcgaggactcagggcaag

SEQ ID NO: 26818 - DNA, 20 bp, Artificial Sequence
  Description of Artificial Sequence: Synthetic oligonucleotide
  Target: FXN; (-) strand; PAM type: YTN; PAM sequence: CTG
cctccttcgaggactcaggg

SEQ ID NO: 26819 - DNA, 20 bp, Artificial Sequence
  Description of Artificial Sequence: Synthetic oligonucleotide
  Target: FXN; (-) strand; PAM type: YTN; PAM sequence: CTC
ctgcctccttcgaggactca

SEQ ID NO: 26820 - DNA, 20 bp, Artificial Sequence
  Description of Artificial Sequence: Synthetic oligonucleotide
  Target: FXN; (-) strand; PAM type: YTN; PAM sequence: CTC
tcctgcctccttcgaggact

SEQ ID NO: 26821 - DNA, 20 bp, Artificial Sequence
  Description of Artificial Sequence: Synthetic oligonucleotide
  Target: FXN; (-) strand; PAM type: YTN; PAM sequence: TTG
atgtctctcctgcctccttc

SEQ ID NO: 26822 - DNA, 20 bp, Artificial Sequence
  Description of Artificial Sequence: Synthetic oligonucleotide
  Target: FXN; (-) strand; PAM type: YTN; PAM sequence: CTT
gatgtctctcctgcctcctt

SEQ ID NO: 26823 - DNA, 20 bp, Artificial Sequence
  Description of Artificial Sequence: Synthetic oligonucleotide
  Target: FXN; (-) strand; PAM type: YTN; PAM sequence: CTG
ccttgatgtctctcctgcct

SEQ ID NO: 26824 - DNA, 20 bp, Artificial Sequence
  Description of Artificial Sequence: Synthetic oligonucleotide
  Target: FXN; (-) strand; PAM type: YTN; PAM sequence: CTG
tctgccttgatgtctctcct

SEQ ID NO: 26825 - DNA, 20 bp, Artificial Sequence
  Description of Artificial Sequence: Synthetic oligonucleotide
  Target: FXN; (-) strand; PAM type: YTN; PAM sequence: CTG
atgagcggcgcctgtctgcc

SEQ ID NO: 26826 - DNA, 20 bp, Artificial Sequence
  Description of Artificial Sequence: Synthetic oligonucleotide
  Target: FXN; (-) strand; PAM type: YTN; PAM sequence: CTC
atcactgatgagcggcgcct

SEQ ID NO: 26827 - DNA, 20 bp, Artificial Sequence
  Description of Artificial Sequence: Synthetic oligonucleotide
  Target: FXN; (-) strand; PAM type: YTN; PAM sequence: CTG
gtctcatcactgatgagcgg

SEQ ID NO: 26828 - DNA, 20 bp, Artificial Sequence
  Description of Artificial Sequence: Synthetic oligonucleotide
  Target: FXN; (-) strand; PAM type: YTN; PAM sequence: TTC
caggtctggtctcatcactg

SEQ ID NO: 26829 - DNA, 20 bp, Artificial Sequence
  Description of Artificial Sequence: Synthetic oligonucleotide
  Target: FXN; (-) strand; PAM type: YTN; PAM sequence: CTG
agtataagacgcgagttcca

SEQ ID NO: 26830 - DNA, 20 bp, Artificial Sequence
  Description of Artificial Sequence: Synthetic oligonucleotide
  Target: FXN; (-) strand; PAM type: YTN; PAM sequence: CTG
gggggccacaatccagcaga

SEQ ID NO: 26831 - DNA, 20 bp, Artificial Sequence
  Description of Artificial Sequence: Synthetic oligonucleotide
  Target: FXN; (-) strand; PAM type: YTN; PAM sequence: CTA
tactggggggccacaatcca

SEQ ID NO: 26832 - DNA, 20 bp, Artificial Sequence
  Description of Artificial Sequence: Synthetic oligonucleotide
  Target: FXN; (-) strand; PAM type: YTN; PAM sequence: TTG
caccctatactggggggcca

SEQ ID NO: 26833 - DNA, 20 bp, Artificial Sequence
  Description of Artificial Sequence: Synthetic oligonucleotide
  Target: FXN; (-) strand; PAM type: YTN; PAM sequence: TTG
tgtgttgcaccctatactgg

SEQ ID NO: 26834 - DNA, 20 bp, Artificial Sequence
  Description of Artificial Sequence: Synthetic oligonucleotide
  Target: FXN; (-) strand; PAM type: YTN; PAM sequence: CTC
cagttgtgtgttgcacccta

SEQ ID NO: 26835 - DNA, 20 bp, Artificial Sequence
  Description of Artificial Sequence: Synthetic oligonucleotide
  Target: FXN; (-) strand; PAM type: YTN; PAM sequence: TTA
aatgctccagttgtgtgttg

SEQ ID NO: 26836 - DNA, 20 bp, Artificial Sequence
  Description of Artificial Sequence: Synthetic oligonucleotide
  Target: FXN; (-) strand; PAM type: YTN; PAM sequence: CTT
aaatgctccagttgtgtgtt

SEQ ID NO: 26837 - DNA, 20 bp, Artificial Sequence
  Description of Artificial Sequence: Synthetic oligonucleotide
  Target: FXN; (-) strand; PAM type: YTN; PAM sequence: TTG
tggcccttaaatgctccagt

SEQ ID NO: 26838 - DNA, 20 bp, Artificial Sequence
  Description of Artificial Sequence: Synthetic oligonucleotide
  Target: FXN; (-) strand; PAM type: YTN; PAM sequence: TTT
gtggcccttaaatgctccag

SEQ ID NO: 26839 - DNA, 20 bp, Artificial Sequence
  Description of Artificial Sequence: Synthetic oligonucleotide
  Target: FXN; (-) strand; PAM type: YTN; PAM sequence: CTT
tgtggcccttaaatgctcca

SEQ ID NO: 26840 - DNA, 20 bp, Artificial Sequence
  Description of Artificial Sequence: Synthetic oligonucleotide
  Target: FXN; (-) strand; PAM type: YTN; PAM sequence: CTC
tttgtggcccttaaatgctc

SEQ ID NO: 26841 - DNA, 20 bp, Artificial Sequence
  Description of Artificial Sequence: Synthetic oligonucleotide
  Target: FXN; (-) strand; PAM type: YTN; PAM sequence: TTC
tctttgtggcccttaaatgc

SEQ ID NO: 26842 - DNA, 20 bp, Artificial Sequence
  Description of Artificial Sequence: Synthetic oligonucleotide
  Target: FXN; (-) strand; PAM type: YTN; PAM sequence: TTG
ttctctttgtggcccttaaa

SEQ ID NO: 26843 - DNA, 20 bp, Artificial Sequence
  Description of Artificial Sequence: Synthetic oligonucleotide
  Target: FXN; (-) strand; PAM type: YTN; PAM sequence: TTT
gttctctttgtggcccttaa

SEQ ID NO: 26844 - DNA, 20 bp, Artificial Sequence
  Description of Artificial Sequence: Synthetic oligonucleotide
  Target: FXN; (-) strand; PAM type: YTN; PAM sequence: TTG
gtaatttgttctctttgtgg

SEQ ID NO: 26845 - DNA, 20 bp, Artificial Sequence
  Description of Artificial Sequence: Synthetic oligonucleotide
  Target: FXN; (-) strand; PAM type: YTN; PAM sequence: CTC
aaagaatcaacacacaatca

SEQ ID NO: 26846 - DNA, 20 bp, Artificial Sequence
  Description of Artificial Sequence: Synthetic oligonucleotide
  Target: FXN; (-) strand; PAM type: YTN; PAM sequence: TTA
aagtataataataaaaaaaa

SEQ ID NO: 26847 - DNA, 20 bp, Artificial Sequence
  Description of Artificial Sequence: Synthetic oligonucleotide
  Target: FXN; (-) strand; PAM type: YTN; PAM sequence: CTT
aaagtataataataaaaaaa

SEQ ID NO: 26848 - DNA, 20 bp, Artificial Sequence
  Description of Artificial Sequence: Synthetic oligonucleotide
  Target: FXN; (-) strand; PAM type: YTN; PAM sequence: CTA
acacttaaagtataataata

SEQ ID NO: 26849 - DNA, 20 bp, Artificial Sequence
  Description of Artificial Sequence: Synthetic oligonucleotide
  Target: FXN; (-) strand; PAM type: YTN; PAM sequence: TTG
tgcacatgtaccctaacact

SEQ ID NO: 26850 - DNA, 20 bp, Artificial Sequence
  Description of Artificial Sequence: Synthetic oligonucleotide
  Target: FXN; (-) strand; PAM type: YTN; PAM sequence: CTG
cacattgtgcacatgtaccc

SEQ ID NO: 26851 - DNA, 20 bp, Artificial Sequence
  Description of Artificial Sequence: Synthetic oligonucleotide
  Target: FXN; (-) strand; PAM type: YTN; PAM sequence: CTA
acctgcacattgtgcacatg

SEQ ID NO: 26852 - DNA, 20 bp, Artificial Sequence
  Description of Artificial Sequence: Synthetic oligonucleotide
  Target: FXN; (-) strand; PAM type: YTN; PAM sequence: TTA
atgggtgcagcacaccagca

SEQ ID NO: 26853 - DNA, 20 bp, Artificial Sequence
  Description of Artificial Sequence: Synthetic oligonucleotide
  Target: FXN; (-) strand; PAM type: YTN; PAM sequence: CTA
aatgacgagttaatgggtgc

SEQ ID NO: 26854 - DNA, 20 bp, Artificial Sequence
  Description of Artificial Sequence: Synthetic oligonucleotide
  Target: FXN; (-) strand; PAM type: YTN; PAM sequence: CTA
atgctaaatgacgagttaat

SEQ ID NO: 26855 - DNA, 20 bp, Artificial Sequence
  Description of Artificial Sequence: Synthetic oligonucleotide
  Target: FXN; (-) strand; PAM type: YTN; PAM sequence: CTA
tacctaatgctaaatgacga

SEQ ID NO: 26856 - DNA, 20 bp, Artificial Sequence
  Description of Artificial Sequence: Synthetic oligonucleotide
  Target: FXN; (-) strand; PAM type: YTN; PAM sequence: TTA
ggagctatacctaatgctaa

SEQ ID NO: 26857 - DNA, 20 bp, Artificial Sequence
  Description of Artificial Sequence: Synthetic oligonucleotide
  Target: FXN; (-) strand; PAM type: YTN; PAM sequence: TTT
aggagctatacctaatgcta

SEQ ID NO: 26858 - DNA, 20 bp, Artificial Sequence
  Description of Artificial Sequence: Synthetic oligonucleotide
  Target: FXN; (-) strand; PAM type: YTN; PAM sequence: CTT
taggagctatacctaatgct

SEQ ID NO: 26859 - DNA, 20 bp, Artificial Sequence
  Description of Artificial Sequence: Synthetic oligonucleotide
  Target: FXN; (-) strand; PAM type: YTN; PAM sequence: TTG
tggggtggagggagggggaa

SEQ ID NO: 26860 - DNA, 20 bp, Artificial Sequence
  Description of Artificial Sequence: Synthetic oligonucleotide
  Target: FXN; (-) strand; PAM type: YTN; PAM sequence: CTG
ttgtggggtggagggagggg

SEQ ID NO: 26861 - DNA, 20 bp, Artificial Sequence
  Description of Artificial Sequence: Synthetic oligonucleotide
  Target: FXN; (-) strand; PAM type: YTN; PAM sequence: CTG
gggactgttgtggggtggag

SEQ ID NO: 26862 - DNA, 20 bp, Artificial Sequence
  Description of Artificial Sequence: Synthetic oligonucleotide
  Target: FXN; (-) strand; PAM type: YTN; PAM sequence: CTC
tggggactgttgtggggtgg

SEQ ID NO: 26863 - DNA, 20 bp, Artificial Sequence
  Description of Artificial Sequence: Synthetic oligonucleotide
  Target: FXN; (-) strand; PAM type: YTN; PAM sequence: CTG
aacaatgagaacacatggtc

SEQ ID NO: 26864 - DNA, 20 bp, Artificial Sequence
  Description of Artificial Sequence: Synthetic oligonucleotide
  Target: FXN; (-) strand; PAM type: YTN; PAM sequence: CTC
ataggtgggaactgaacaat

SEQ ID NO: 26865 - DNA, 20 bp, Artificial Sequence
  Description of Artificial Sequence: Synthetic oligonucleotide
  Target: FXN; (-) strand; PAM type: YTN; PAM sequence: CTC
actcataggtgggaactgaa

SEQ ID NO: 26866 - DNA, 20 bp, Artificial Sequence
  Description of Artificial Sequence: Synthetic oligonucleotide
  Target: FXN; (-) strand; PAM type: YTN; PAM sequence: TTC
tcactcataggtgggaactg

SEQ ID NO: 26867 - DNA, 20 bp, Artificial Sequence
  Description of Artificial Sequence: Synthetic oligonucleotide
  Target: FXN; (-) strand; PAM type: YTN; PAM sequence: CTG
catattctcactcataggtg

SEQ ID NO: 26868 - DNA, 20 bp, Artificial Sequence
  Description of Artificial Sequence: Synthetic oligonucleotide
  Target: FXN; (-) strand; PAM type: YTN; PAM sequence: CTA
tcgcaagaacaaaaaatcaa

SEQ ID NO: 26869 - DNA, 20 bp, Artificial Sequence
  Description of Artificial Sequence: Synthetic oligonucleotide
  Target: FXN; (-) strand; PAM type: YTN; PAM sequence: CTC
agtaaactatcgcaagaaca

SEQ ID NO: 26870 - DNA, 20 bp, Artificial Sequence
  Description of Artificial Sequence: Synthetic oligonucleotide
  Target: FXN; (-) strand; PAM type: YTN; PAM sequence: TTC
tcagtaaactatcgcaagaa

SEQ ID NO: 26871 - DNA, 20 bp, Artificial Sequence
  Description of Artificial Sequence: Synthetic oligonucleotide
  Target: FXN; (-) strand; PAM type: YTN; PAM sequence: CTG
gaaatcatcattctcagtaa

SEQ ID NO: 26872 - DNA, 20 bp, Artificial Sequence
  Description of Artificial Sequence: Synthetic oligonucleotide
  Target: FXN; (-) strand; PAM type: YTN; PAM sequence: TTG
tagggacatggatgaaactg

SEQ ID NO: 26873 - DNA, 20 bp, Artificial Sequence
  Description of Artificial Sequence: Synthetic oligonucleotide
  Target: FXN; (-) strand; PAM type: YTN; PAM sequence: TTT
gtagggacatggatgaaact

SEQ ID NO: 26874 - DNA, 20 bp, Artificial Sequence
  Description of Artificial Sequence: Synthetic oligonucleotide
  Target: FXN; (-) strand; PAM type: YTN; PAM sequence: CTT
tgtagggacatggatgaaac

SEQ ID NO: 26875 - DNA, 20 bp, Artificial Sequence
  Description of Artificial Sequence: Synthetic oligonucleotide
  Target: FXN; (-) strand; PAM type: YTN; PAM sequence: TTC
atgtcctttgtagggacatg

SEQ ID NO: 26876 - DNA, 20 bp, Artificial Sequence
  Description of Artificial Sequence: Synthetic oligonucleotide
  Target: FXN; (-) strand; PAM type: YTN; PAM sequence: CTA
tgcagcaataaaaaatgatg

SEQ ID NO: 26877 - DNA, 20 bp, Artificial Sequence
  Description of Artificial Sequence: Synthetic oligonucleotide
  Target: FXN; (-) strand; PAM type: YTN; PAM sequence: TTA
agaaaatgtggcacatatac

SEQ ID NO: 26878 - DNA, 20 bp, Artificial Sequence
  Description of Artificial Sequence: Synthetic oligonucleotide
  Target: FXN; (-) strand; PAM type: YTN; PAM sequence: CTG
gattaagaaaatgtggcaca

SEQ ID NO: 26879 - DNA, 20 bp, Artificial Sequence
  Description of Artificial Sequence: Synthetic oligonucleotide
  Target: FXN; (-) strand; PAM type: YTN; PAM sequence: CTC
atccaacaatgatagactgg

SEQ ID NO: 26880 - DNA, 20 bp, Artificial Sequence
  Description of Artificial Sequence: Synthetic oligonucleotide
  Target: FXN; (-) strand; PAM type: YTN; PAM sequence: TTC
catgagataaagagctcatc

SEQ ID NO: 26881 - DNA, 20 bp, Artificial Sequence
  Description of Artificial Sequence: Synthetic oligonucleotide
  Target: FXN; (-) strand; PAM type: YTN; PAM sequence: TTT
ccatgagataaagagctcat

SEQ ID NO: 26882 - DNA, 20 bp, Artificial Sequence
  Description of Artificial Sequence: Synthetic oligonucleotide
  Target: FXN; (-) strand; PAM type: YTN; PAM sequence: TTT
tccatgagataaagagctca

SEQ ID NO: 26883 - DNA, 20 bp, Artificial Sequence
  Description of Artificial Sequence: Synthetic oligonucleotide
  Target: FXN; (-) strand; PAM type: YTN; PAM sequence: TTT
ttccatgagataaagagctc

SEQ ID NO: 26884 - DNA, 20 bp, Artificial Sequence
  Description of Artificial Sequence: Synthetic oligonucleotide
  Target: FXN; (-) strand; PAM type: YTN; PAM sequence: TTA
tttttccatgagataaagag

SEQ ID NO: 26885 - DNA, 20 bp, Artificial Sequence
  Description of Artificial Sequence: Synthetic oligonucleotide
  Target: FXN; (-) strand; PAM type: YTN; PAM sequence: TTA
taaattatttttccatgaga

SEQ ID NO: 26886 - DNA, 20 bp, Artificial Sequence
  Description of Artificial Sequence: Synthetic oligonucleotide
  Target: FXN; (-) strand; PAM type: YTN; PAM sequence: TTT
ataaattatttttccatgag

SEQ ID NO: 26887 - DNA, 20 bp, Artificial Sequence
  Description of Artificial Sequence: Synthetic oligonucleotide
  Target: FXN; (-) strand; PAM type: YTN; PAM sequence: TTT
tataaattatttttccatga

SEQ ID NO: 26888 - DNA, 20 bp, Artificial Sequence
  Description of Artificial Sequence: Synthetic oligonucleotide
  Target: FXN; (-) strand; PAM type: YTN; PAM sequence: CTC
atacagagttttataaatta

SEQ ID NO: 26889 - DNA, 20 bp, Artificial Sequence
  Description of Artificial Sequence: Synthetic oligonucleotide
  Target: FXN; (-) strand; PAM type: YTN; PAM sequence: CTC
tcatacagagttttataaat

SEQ ID NO: 26890 - DNA, 20 bp, Artificial Sequence
  Description of Artificial Sequence: Synthetic oligonucleotide
  Target: FXN; (-) strand; PAM type: YTN; PAM sequence: CTC
ctctcatacagagttttata

SEQ ID NO: 26891 - DNA, 20 bp, Artificial Sequence
  Description of Artificial Sequence: Synthetic oligonucleotide
  Target: FXN; (-) strand; PAM type: YTN; PAM sequence: TTC
ccactcctctcatacagagt

SEQ ID NO: 26892 - DNA, 20 bp, Artificial Sequence
  Description of Artificial Sequence: Synthetic oligonucleotide
  Target: FXN; (-) strand; PAM type: YTN; PAM sequence: TTT
cccactcctctcatacagag

SEQ ID NO: 26893 - DNA, 20 bp, Artificial Sequence
  Description of Artificial Sequence: Synthetic oligonucleotide
  Target: FXN; (-) strand; PAM type: YTN; PAM sequence: CTA
tttcccactcctctcataca

SEQ ID NO: 26894 - DNA, 20 bp, Artificial Sequence
  Description of Artificial Sequence: Synthetic oligonucleotide
  Target: FXN; (-) strand; PAM type: YTN; PAM sequence: TTA
atactatttcccactcctct

SEQ ID NO: 26895 - DNA, 20 bp, Artificial Sequence
  Description of Artificial Sequence: Synthetic oligonucleotide
  Target: FXN; (-) strand; PAM type: YTN; PAM sequence: TTG
tcccaaaaagaaaccccgca

SEQ ID NO: 26896 - DNA, 20 bp, Artificial Sequence
  Description of Artificial Sequence: Synthetic oligonucleotide
  Target: FXN; (-) strand; PAM type: YTN; PAM sequence: TTC
cattgtcccaaaaagaaacc

SEQ ID NO: 26897 - DNA, 20 bp, Artificial Sequence
  Description of Artificial Sequence: Synthetic oligonucleotide
  Target: FXN; (-) strand; PAM type: YTN; PAM sequence: TTT
ccattgtcccaaaaagaaac

SEQ ID NO: 26898 - DNA, 20 bp, Artificial Sequence
  Description of Artificial Sequence: Synthetic oligonucleotide
  Target: FXN; (-) strand; PAM type: YTN; PAM sequence: CTA
tttccattgtcccaaaaaga

SEQ ID NO: 26899 - DNA, 20 bp, Artificial Sequence
  Description of Artificial Sequence: Synthetic oligonucleotide
  Target: FXN; (-) strand; PAM type: YTN; PAM sequence: TTC
cagctatttccattgtccca

SEQ ID NO: 26900 - DNA, 20 bp, Artificial Sequence
  Description of Artificial Sequence: Synthetic oligonucleotide
  Target: FXN; (-) strand; PAM type: YTN; PAM sequence: CTA
attccagctatttccattgt

SEQ ID NO: 26901 - DNA, 20 bp, Artificial Sequence
  Description of Artificial Sequence: Synthetic oligonucleotide
  Target: FXN; (-) strand; PAM type: YTN; PAM sequence: CTA
tctaattccagctatttcca

SEQ ID NO: 26902 - DNA, 20 bp, Artificial Sequence
  Description of Artificial Sequence: Synthetic oligonucleotide
  Target: FXN; (-) strand; PAM type: YTN; PAM sequence: TTC
acaaagtgtgcaaacatcac

SEQ ID NO: 26903 - DNA, 20 bp, Artificial Sequence
  Description of Artificial Sequence: Synthetic oligonucleotide
  Target: FXN; (-) strand; PAM type: YTN; PAM sequence: TTT
cacaaagtgtgcaaacatca

SEQ ID NO: 26904 - DNA, 20 bp, Artificial Sequence
  Description of Artificial Sequence: Synthetic oligonucleotide
  Target: FXN; (-) strand; PAM type: YTN; PAM sequence: TTA
gtatttcacaaagtgtgcaa

SEQ ID NO: 26905 - DNA, 20 bp, Artificial Sequence
  Description of Artificial Sequence: Synthetic oligonucleotide
  Target: FXN; (-) strand; PAM type: YTN; PAM sequence: TTT
agtatttcacaaagtgtgca

SEQ ID NO: 26906 - DNA, 20 bp, Artificial Sequence
  Description of Artificial Sequence: Synthetic oligonucleotide
  Target: FXN; (-) strand; PAM type: YTN; PAM sequence: TTT
tagtatttcacaaagtgtgc

SEQ ID NO: 26907 - DNA, 20 bp, Artificial Sequence
  Description of Artificial Sequence: Synthetic oligonucleotide
  Target: FXN; (-) strand; PAM type: YTN; PAM sequence: TTT
ttagtatttcacaaagtgtg

SEQ ID NO: 26908 - DNA, 20 bp, Artificial Sequence
  Description of Artificial Sequence: Synthetic oligonucleotide
  Target: FXN; (-) strand; PAM type: YTN; PAM sequence: TTC
aggagtttttagtatttcac

SEQ ID NO: 26909 - DNA, 20 bp, Artificial Sequence
  Description of Artificial Sequence: Synthetic oligonucleotide
  Target: FXN; (-) strand; PAM type: YTN; PAM sequence: CTG
tataattcaggagtttttag

SEQ ID NO: 26910 - DNA, 20 bp, Artificial Sequence
  Description of Artificial Sequence: Synthetic oligonucleotide
  Target: FXN; (-) strand; PAM type: YTN; PAM sequence: TTA
aaactgtataattcaggagt

SEQ ID NO: 26911 - DNA, 20 bp, Artificial Sequence
  Description of Artificial Sequence: Synthetic oligonucleotide
  Target: FXN; (-) strand; PAM type: YTN; PAM sequence: CTT
aaaactgtataattcaggag

SEQ ID NO: 26912 - DNA, 20 bp, Artificial Sequence
  Description of Artificial Sequence: Synthetic oligonucleotide
  Target: FXN; (-) strand; PAM type: YTN; PAM sequence: TTC
ttaaaactgtataattcagg

SEQ ID NO: 26913 - DNA, 20 bp, Artificial Sequence
  Description of Artificial Sequence: Synthetic oligonucleotide
  Target: FXN; (-) strand; PAM type: YTN; PAM sequence: TTT
cttaaaactgtataattcag

SEQ ID NO: 26914 - DNA, 20 bp, Artificial Sequence
  Description of Artificial Sequence: Synthetic oligonucleotide
  Target: FXN; (-) strand; PAM type: YTN; PAM sequence: CTC
aaaaacaaataaataaaagt

SEQ ID NO: 26915 - DNA, 20 bp, Artificial Sequence
  Description of Artificial Sequence: Synthetic oligonucleotide
  Target: FXN; (-) strand; PAM type: YTN; PAM sequence: CTC
tcaaaaacaaataaataaaa

SEQ ID NO: 26916 - DNA, 20 bp, Artificial Sequence
  Description of Artificial Sequence: Synthetic oligonucleotide
  Target: FXN; (-) strand; PAM type: YTN; PAM sequence: TTC
tctcaaaaacaaataaataa

SEQ ID NO: 26917 - DNA, 20 bp, Artificial Sequence
  Description of Artificial Sequence: Synthetic oligonucleotide
  Target: FXN; (-) strand; PAM type: YTN; PAM sequence: CTT
ctctcaaaaacaaataaata

SEQ ID NO: 26918 - DNA, 20 bp, Artificial Sequence
  Description of Artificial Sequence: Synthetic oligonucleotide
  Target: FXN; (-) strand; PAM type: YTN; PAM sequence: CTG
ggtgacacagagaacttctc

SEQ ID NO: 26919 - DNA, 20 bp, Artificial Sequence
  Description of Artificial Sequence: Synthetic oligonucleotide
  Target: FXN; (-) strand; PAM type: YTN; PAM sequence: TTC
agcctgggtgacacagagaa

SEQ ID NO: 26920 - DNA, 20 bp, Artificial Sequence
  Description of Artificial Sequence: Synthetic oligonucleotide
  Target: FXN; (-) strand; PAM type: YTN; PAM sequence: CTT
cagcctgggtgacacagaga

SEQ ID NO: 26921 - DNA, 20 bp, Artificial Sequence
  Description of Artificial Sequence: Synthetic oligonucleotide
  Target: FXN; (-) strand; PAM type: YTN; PAM sequence: CTG
caataaccggtgatcacgcc

SEQ ID NO: 26922 - DNA, 20 bp, Artificial Sequence
  Description of Artificial Sequence: Synthetic oligonucleotide
  Target: FXN; (-) strand; PAM type: YTN; PAM sequence: TTG
aggctgcaataaccggtgat

SEQ ID NO: 26923 - DNA, 20 bp, Artificial Sequence
  Description of Artificial Sequence: Synthetic oligonucleotide
  Target: FXN; (-) strand; PAM type: YTN; PAM sequence: CTC
agagattgaggctgcaataa

SEQ ID NO: 26924 - DNA, 20 bp, Artificial Sequence
  Description of Artificial Sequence: Synthetic oligonucleotide
  Target: FXN; (-) strand; PAM type: YTN; PAM sequence: TTG
agcctcagagattgaggctg

SEQ ID NO: 26925 - DNA, 20 bp, Artificial Sequence
  Description of Artificial Sequence: Synthetic oligonucleotide
  Target: FXN; (-) strand; PAM type: YTN; PAM sequence: CTT
gagcctcagagattgaggct

SEQ ID NO: 26926 - DNA, 20 bp, Artificial Sequence
  Description of Artificial Sequence: Synthetic oligonucleotide
  Target: FXN; (-) strand; PAM type: YTN; PAM sequence: CTG
aggtgggagaatcgcttgag

SEQ ID NO: 26927 - DNA, 20 bp, Artificial Sequence
  Description of Artificial Sequence: Synthetic oligonucleotide
  Target: FXN; (-) strand; PAM type: YTN; PAM sequence: TTG
gtaggctgaggtgggagaat

SEQ ID NO: 26928 - DNA, 20 bp, Artificial Sequence
  Description of Artificial Sequence: Synthetic oligonucleotide
  Target: FXN; (-) strand; PAM type: YTN; PAM sequence: CTT
ggtaggctgaggtgggagaa

SEQ ID NO: 26929 - DNA, 20 bp, Artificial Sequence
  Description of Artificial Sequence: Synthetic oligonucleotide
  Target: FXN; (-) strand; PAM type: YTN; PAM sequence: CTA
cttggtaggctgaggtggga

SEQ ID NO: 26930 - DNA, 20 bp, Artificial Sequence
  Description of Artificial Sequence: Synthetic oligonucleotide
  Target: FXN; (-) strand; PAM type: YTN; PAM sequence: CTA
tagtcacatctacttggtag

SEQ ID NO: 26931 - DNA, 20 bp, Artificial Sequence
  Description of Artificial Sequence: Synthetic oligonucleotide
  Target: FXN; (-) strand; PAM type: YTN; PAM sequence: CTG
ggtgtggtggtgcgcaccta

SEQ ID NO: 26932 - DNA, 20 bp, Artificial Sequence
  Description of Artificial Sequence: Synthetic oligonucleotide
  Target: FXN; (-) strand; PAM type: YTN; PAM sequence: TTC
actgggtgtggtggtgcgca

SEQ ID NO: 26933 - DNA, 20 bp, Artificial Sequence
  Description of Artificial Sequence: Synthetic oligonucleotide
  Target: FXN; (-) strand; PAM type: YTN; PAM sequence: TTA
caaattcactgggtgtggtg

SEQ ID NO: 26934 - DNA, 20 bp, Artificial Sequence
  Description of Artificial Sequence: Synthetic oligonucleotide
  Target: FXN; (-) strand; PAM type: YTN; PAM sequence: TTA
caaaaaattacaaattcact

SEQ ID NO: 26935 - DNA, 20 bp, Artificial Sequence
  Description of Artificial Sequence: Synthetic oligonucleotide
  Target: FXN; (-) strand; PAM type: YTN; PAM sequence: TTT
acaaaaaattacaaattcac

SEQ ID NO: 26936 - DNA, 20 bp, Artificial Sequence
  Description of Artificial Sequence: Synthetic oligonucleotide
  Target: FXN; (-) strand; PAM type: YTN; PAM sequence: TTT
tacaaaaaattacaaattca

SEQ ID NO: 26937 - DNA, 20 bp, Artificial Sequence
  Description of Artificial Sequence: Synthetic oligonucleotide
  Target: FXN; (-) strand; PAM type: YTN; PAM sequence: TTT
ttacaaaaaattacaaattc

SEQ ID NO: 26938 - DNA, 20 bp, Artificial Sequence
  Description of Artificial Sequence: Synthetic oligonucleotide
  Target: FXN; (-) strand; PAM type: YTN; PAM sequence: TTG
tttttacaaaaaattacaaa

SEQ ID NO: 26939 - DNA, 20 bp, Artificial Sequence
  Description of Artificial Sequence: Synthetic oligonucleotide
  Target: FXN; (-) strand; PAM type: YTN; PAM sequence: CTT
gtttttacaaaaaattacaa

SEQ ID NO: 26940 - DNA, 20 bp, Artificial Sequence
  Description of Artificial Sequence: Synthetic oligonucleotide
  Target: FXN; (-) strand; PAM type: YTN; PAM sequence: CTG
ggcaacatggtaaaaccttg

SEQ ID NO: 26941 - DNA, 20 bp, Artificial Sequence
  Description of Artificial Sequence: Synthetic oligonucleotide
  Target: FXN; (-) strand; PAM type: YTN; PAM sequence: TTC
aagaccagactgggcaacat

SEQ ID NO: 26942 - DNA, 20 bp, Artificial Sequence
  Description of Artificial Sequence: Synthetic oligonucleotide
  Target: FXN; (-) strand; PAM type: YTN; PAM sequence: TTG
ggcccaggagttcaagacca

SEQ ID NO: 26943 - DNA, 20 bp, Artificial Sequence
  Description of Artificial Sequence: Synthetic oligonucleotide
  Target: FXN; (-) strand; PAM type: YTN; PAM sequence: CTT
gggcccaggagttcaagacc

SEQ ID NO: 26944 - DNA, 20 bp, Artificial Sequence
  Description of Artificial Sequence: Synthetic oligonucleotide
  Target: FXN; (-) strand; PAM type: YTN; PAM sequence: TTC
gggagcccaaggagggagga

SEQ ID NO: 26945 - DNA, 20 bp, Artificial Sequence
  Description of Artificial Sequence: Synthetic oligonucleotide
  Target: FXN; (-) strand; PAM type: YTN; PAM sequence: CTT
cgggagcccaaggagggagg

SEQ ID NO: 26946 - DNA, 20 bp, Artificial Sequence
  Description of Artificial Sequence: Synthetic oligonucleotide
  Target: FXN; (-) strand; PAM type: YTN; PAM sequence: CTG
gcacttcgggagcccaagga

SEQ ID NO: 26947 - DNA, 20 bp, Artificial Sequence
  Description of Artificial Sequence: Synthetic oligonucleotide
  Target: FXN; (-) strand; PAM type: YTN; PAM sequence: TTG
tatcctggcacttcgggagc

SEQ ID NO: 26948 - DNA, 20 bp, Artificial Sequence
  Description of Artificial Sequence: Synthetic oligonucleotide
  Target: FXN; (-) strand; PAM type: YTN; PAM sequence: CTT
gtatcctggcacttcgggag

SEQ ID NO: 26949 - DNA, 20 bp, Artificial Sequence
  Description of Artificial Sequence: Synthetic oligonucleotide
  Target: FXN; (-) strand; PAM type: YTN; PAM sequence: CTC
atgcttgtatcctggcactt

SEQ ID NO: 26950 - DNA, 20 bp, Artificial Sequence
  Description of Artificial Sequence: Synthetic oligonucleotide
  Target: FXN; (-) strand; PAM type: YTN; PAM sequence: CTG
catgtggtgactcatgcttg

SEQ ID NO: 26951 - DNA, 20 bp, Artificial Sequence
  Description of Artificial Sequence: Synthetic oligonucleotide
  Target: FXN; (-) strand; PAM type: YTN; PAM sequence: CTG
aggctgcatgtggtgactca

SEQ ID NO: 26952 - DNA, 20 bp, Artificial Sequence
  Description of Artificial Sequence: Synthetic oligonucleotide
  Target: FXN; (-) strand; PAM type: YTN; PAM sequence: TTA
aaactgaggctgcatgtggt

SEQ ID NO: 26953 - DNA, 20 bp, Artificial Sequence
  Description of Artificial Sequence: Synthetic oligonucleotide
  Target: FXN; (-) strand; PAM type: YTN; PAM sequence: CTT
aaaactgaggctgcatgtgg

SEQ ID NO: 26954 - DNA, 20 bp, Artificial Sequence
  Description of Artificial Sequence: Synthetic oligonucleotide
  Target: FXN; (-) strand; PAM type: YTN; PAM sequence: TTC
ttaaaactgaggctgcatgt

SEQ ID NO: 26955 - DNA, 20 bp, Artificial Sequence
  Description of Artificial Sequence: Synthetic oligonucleotide
  Target: FXN; (-) strand; PAM type: YTN; PAM sequence: TTT
cttaaaactgaggctgcatg

SEQ ID NO: 26956 - DNA, 20 bp, Artificial Sequence
  Description of Artificial Sequence: Synthetic oligonucleotide
  Target: FXN; (-) strand; PAM type: YTN; PAM sequence: TTA
aaagtttcttaaaactgagg

SEQ ID NO: 26957 - DNA, 20 bp, Artificial Sequence
  Description of Artificial Sequence: Synthetic oligonucleotide
  Target: FXN; (-) strand; PAM type: YTN; PAM sequence: TTT
aaaagtttcttaaaactgag

SEQ ID NO: 26958 - DNA, 20 bp, Artificial Sequence
  Description of Artificial Sequence: Synthetic oligonucleotide
  Target: FXN; (-) strand; PAM type: YTN; PAM sequence: TTA
tttaaaagtttcttaaaact

SEQ ID NO: 26959 - DNA, 20 bp, Artificial Sequence
  Description of Artificial Sequence: Synthetic oligonucleotide
  Target: FXN; (-) strand; PAM type: YTN; PAM sequence: TTT
atttaaaagtttcttaaaac

SEQ ID NO: 26960 - DNA, 20 bp, Artificial Sequence
  Description of Artificial Sequence: Synthetic oligonucleotide
  Target: FXN; (-) strand; PAM type: YTN; PAM sequence: TTC
atttatttaaaagtttctta

SEQ ID NO: 26961 - DNA, 20 bp, Artificial Sequence
  Description of Artificial Sequence: Synthetic oligonucleotide
  Target: FXN; (-) strand; PAM type: YTN; PAM sequence: TTT
catttatttaaaagtttctt

SEQ ID NO: 26962 - DNA, 20 bp, Artificial Sequence
  Description of Artificial Sequence: Synthetic oligonucleotide
  Target: FXN; (-) strand; PAM type: YTN; PAM sequence: CTA
tatttcatttatttaaaagt

SEQ ID NO: 26963 - DNA, 20 bp, Artificial Sequence
  Description of Artificial Sequence: Synthetic oligonucleotide
  Target: FXN; (-) strand; PAM type: YTN; PAM sequence: TTG
gtatgactatatttcattta

SEQ ID NO: 26964 - DNA, 20 bp, Artificial Sequence
  Description of Artificial Sequence: Synthetic oligonucleotide
  Target: FXN; (-) strand; PAM type: YTN; PAM sequence: TTT
ggtatgactatatttcattt

SEQ ID NO: 26965 - DNA, 20 bp, Artificial Sequence
  Description of Artificial Sequence: Synthetic oligonucleotide
  Target: FXN; (-) strand; PAM type: YTN; PAM sequence: TTT
tggtatgactatatttcatt

SEQ ID NO: 26966 - DNA, 20 bp, Artificial Sequence
  Description of Artificial Sequence: Synthetic oligonucleotide
  Target: FXN; (-) strand; PAM type: YTN; PAM sequence: CTG
ttttggtatgactatatttc

SEQ ID NO: 26967 - DNA, 20 bp, Artificial Sequence
  Description of Artificial Sequence: Synthetic oligonucleotide
  Target: FXN; (-) strand; PAM type: YTN; PAM sequence: TTA
ctgttttggtatgactatat

SEQ ID NO: 26968 - DNA, 20 bp, Artificial Sequence
  Description of Artificial Sequence: Synthetic oligonucleotide
  Target: FXN; (-) strand; PAM type: YTN; PAM sequence: TTT
actgttttggtatgactata

SEQ ID NO: 26969 - DNA, 20 bp, Artificial Sequence
  Description of Artificial Sequence: Synthetic oligonucleotide
  Target: FXN; (-) strand; PAM type: YTN; PAM sequence: TTT
tactgttttggtatgactat

SEQ ID NO: 26970 - DNA, 20 bp, Artificial Sequence
  Description of Artificial Sequence: Synthetic oligonucleotide
  Target: FXN; (-) strand; PAM type: YTN; PAM sequence: TTT
ttactgttttggtatgacta

SEQ ID NO: 26971 - DNA, 20 bp, Artificial Sequence
  Description of Artificial Sequence: Synthetic oligonucleotide
  Target: FXN; (-) strand; PAM type: YTN; PAM sequence: CTG
aaacccatttttactgtttt

SEQ ID NO: 26972 - DNA, 20 bp, Artificial Sequence
  Description of Artificial Sequence: Synthetic oligonucleotide
  Target: FXN; (-) strand; PAM type: YTN; PAM sequence: TTC
ctgaaacccatttttactgt

SEQ ID NO: 26973 - DNA, 20 bp, Artificial Sequence
  Description of Artificial Sequence: Synthetic oligonucleotide
  Target: FXN; (-) strand; PAM type: YTN; PAM sequence: TTT
cctgaaacccatttttactg

SEQ ID NO: 26974 - DNA, 20 bp, Artificial Sequence
  Description of Artificial Sequence: Synthetic oligonucleotide
  Target: FXN; (-) strand; PAM type: YTN; PAM sequence: TTT
tcctgaaacccatttttact

SEQ ID NO: 26975 - DNA, 20 bp, Artificial Sequence
  Description of Artificial Sequence: Synthetic oligonucleotide
  Target: FXN; (-) strand; PAM type: YTN; PAM sequence: TTT
ttcctgaaacccatttttac

SEQ ID NO: 26976 - DNA, 20 bp, Artificial Sequence
  Description of Artificial Sequence: Synthetic oligonucleotide
  Target: FXN; (-) strand; PAM type: YTN; PAM sequence: TTT
tttcctgaaacccattttta

SEQ ID NO: 26977 - DNA, 20 bp, Artificial Sequence
  Description of Artificial Sequence: Synthetic oligonucleotide
  Target: FXN; (-) strand; PAM type: YTN; PAM sequence: TTT
ttttcctgaaacccattttt

SEQ ID NO: 26978 - DNA, 20 bp, Artificial Sequence
  Description of Artificial Sequence: Synthetic oligonucleotide
  Target: FXN; (-) strand; PAM type: YTN; PAM sequence: TTT
tttttcctgaaacccatttt

SEQ ID NO: 26979 - DNA, 20 bp, Artificial Sequence
  Description of Artificial Sequence: Synthetic oligonucleotide
  Target: FXN; (-) strand; PAM type: YTN; PAM sequence: TTA
aaaaaacattttttttcctg

SEQ ID NO: 26980 - DNA, 20 bp, Artificial Sequence
  Description of Artificial Sequence: Synthetic oligonucleotide
  Target: FXN; (-) strand; PAM type: YTN; PAM sequence: TTT
aaaaaaacattttttttcct

SEQ ID NO: 26981 - DNA, 20 bp, Artificial Sequence
  Description of Artificial Sequence: Synthetic oligonucleotide
  Target: FXN; (-) strand; PAM type: YTN; PAM sequence: TTG
tttaaaaaaacatttttttt

SEQ ID NO: 26982 - DNA, 20 bp, Artificial Sequence
  Description of Artificial Sequence: Synthetic oligonucleotide
  Target: FXN; (-) strand; PAM type: YTN; PAM sequence: TTT
gtttaaaaaaacattttttt

SEQ ID NO: 26983 - DNA, 20 bp, Artificial Sequence
  Description of Artificial Sequence: Synthetic oligonucleotide
  Target: FXN; (-) strand; PAM type: YTN; PAM sequence: TTA
tacaatacgtaagtttgttt

SEQ ID NO: 26984 - DNA, 20 bp, Artificial Sequence
  Description of Artificial Sequence: Synthetic oligonucleotide
  Target: FXN; (-) strand; PAM type: YTN; PAM sequence: CTG
ggattatacaatacgtaagt

SEQ ID NO: 26985 - DNA, 20 bp, Artificial Sequence
  Description of Artificial Sequence: Synthetic oligonucleotide
  Target: FXN; (-) strand; PAM type: YTN; PAM sequence: TTA
aaagggctgggattatacaa

SEQ ID NO: 26986 - DNA, 20 bp, Artificial Sequence
  Description of Artificial Sequence: Synthetic oligonucleotide
  Target: FXN; (-) strand; PAM type: YTN; PAM sequence: TTT
aaaagggctgggattataca

SEQ ID NO: 26987 - DNA, 20 bp, Artificial Sequence
  Description of Artificial Sequence: Synthetic oligonucleotide
  Target: FXN; (-) strand; PAM type: YTN; PAM sequence: TTT
taaaagggctgggattatac

SEQ ID NO: 26988 - DNA, 20 bp, Artificial Sequence
  Description of Artificial Sequence: Synthetic oligonucleotide
  Target: FXN; (-) strand; PAM type: YTN; PAM sequence: TTT
ttaaaagggctgggattata

SEQ ID NO: 26989 - DNA, 20 bp, Artificial Sequence
  Description of Artificial Sequence: Synthetic oligonucleotide
  Target: FXN; (-) strand; PAM type: YTN; PAM sequence: TTT
tttaaaagggctgggattat

SEQ ID NO: 26990 - DNA, 20 bp, Artificial Sequence
  Description of Artificial Sequence: Synthetic oligonucleotide
  Target: FXN; (-) strand; PAM type: YTN; PAM sequence: TTG
aaagcattttttaaaagggc

SEQ ID NO: 26991 - DNA, 20 bp, Artificial Sequence
  Description of Artificial Sequence: Synthetic oligonucleotide
  Target: FXN; (-) strand; PAM type: YTN; PAM sequence: TTT
gaaagcattttttaaaaggg

SEQ ID NO: 26992 - DNA, 20 bp, Artificial Sequence
  Description of Artificial Sequence: Synthetic oligonucleotide
  Target: FXN; (-) strand; PAM type: YTN; PAM sequence: TTT
tgaaagcattttttaaaagg

SEQ ID NO: 26993 - DNA, 20 bp, Artificial Sequence
  Description of Artificial Sequence: Synthetic oligonucleotide
  Target: FXN; (-) strand; PAM type: YTN; PAM sequence: TTT
ttgaaagcattttttaaaag

SEQ ID NO: 26994 - DNA, 20 bp, Artificial Sequence
  Description of Artificial Sequence: Synthetic oligonucleotide
  Target: FXN; (-) strand; PAM type: YTN; PAM sequence: CTG
ccagtttttgaaagcatttt

SEQ ID NO: 26995 - DNA, 20 bp, Artificial Sequence
  Description of Artificial Sequence: Synthetic oligonucleotide
  Target: FXN; (-) strand; PAM type: YTN; PAM sequence: TTG
actgccagtttttgaaagca

SEQ ID NO: 26996 - DNA, 20 bp, Artificial Sequence
  Description of Artificial Sequence: Synthetic oligonucleotide
  Target: FXN; (-) strand; PAM type: YTN; PAM sequence: TTA
tgagttgactgccagttttt

SEQ ID NO: 26997 - DNA, 20 bp, Artificial Sequence
  Description of Artificial Sequence: Synthetic oligonucleotide
  Target: FXN; (-) strand; PAM type: YTN; PAM sequence: TTT
atgagttgactgccagtttt

SEQ ID NO: 26998 - DNA, 20 bp, Artificial Sequence
  Description of Artificial Sequence: Synthetic oligonucleotide
  Target: FXN; (-) strand; PAM type: YTN; PAM sequence: TTT
tatgagttgactgccagttt

SEQ ID NO: 26999 - DNA, 20 bp, Artificial Sequence
  Description of Artificial Sequence: Synthetic oligonucleotide
  Target: FXN; (-) strand; PAM type: YTN; PAM sequence: CTT
ttatgagttgactgccagtt

SEQ ID NO: 27000 - DNA, 20 bp, Artificial Sequence
  Description of Artificial Sequence: Synthetic oligonucleotide
  Target: FXN; (-) strand; PAM type: YTN; PAM sequence: TTG
tccttttatgagttgactgc

SEQ ID NO: 27001 - DNA, 20 bp, Artificial Sequence
  Description of Artificial Sequence: Synthetic oligonucleotide
  Target: FXN; (-) strand; PAM type: YTN; PAM sequence: TTT
gtccttttatgagttgactg

SEQ ID NO: 27002 - DNA, 20 bp, Artificial Sequence
  Description of Artificial Sequence: Synthetic oligonucleotide
  Target: FXN; (-) strand; PAM type: YTN; PAM sequence: TTC
atcagtggaatcataagtat

SEQ ID NO: 27003 - DNA, 20 bp, Artificial Sequence
  Description of Artificial Sequence: Synthetic oligonucleotide
  Target: FXN; (-) strand; PAM type: YTN; PAM sequence: CTT
catcagtggaatcataagta

SEQ ID NO: 27004 - DNA, 20 bp, Artificial Sequence
  Description of Artificial Sequence: Synthetic oligonucleotide
  Target: FXN; (-) strand; PAM type: YTN; PAM sequence: CTA
cttcatcagtggaatcataa

SEQ ID NO: 27005 - DNA, 20 bp, Artificial Sequence
  Description of Artificial Sequence: Synthetic oligonucleotide
  Target: FXN; (-) strand; PAM type: YTN; PAM sequence: TTG
actacttcatcagtggaatc

SEQ ID NO: 27006 - DNA, 20 bp, Artificial Sequence
  Description of Artificial Sequence: Synthetic oligonucleotide
  Target: FXN; (-) strand; PAM type: YTN; PAM sequence: TTT
gactacttcatcagtggaat

SEQ ID NO: 27007 - DNA, 20 bp, Artificial Sequence
  Description of Artificial Sequence: Synthetic oligonucleotide
  Target: FXN; (-) strand; PAM type: YTN; PAM sequence: TTT
tgactacttcatcagtggaa

SEQ ID NO: 27008 - DNA, 20 bp, Artificial Sequence
  Description of Artificial Sequence: Synthetic oligonucleotide
  Target: FXN; (-) strand; PAM type: YTN; PAM sequence: CTT
ttgactacttcatcagtgga

SEQ ID NO: 27009 - DNA, 20 bp, Artificial Sequence
  Description of Artificial Sequence: Synthetic oligonucleotide
  Target: FXN; (-) strand; PAM type: YTN; PAM sequence: CTA
cttttgactacttcatcagt

SEQ ID NO: 27010 - DNA, 20 bp, Artificial Sequence
  Description of Artificial Sequence: Synthetic oligonucleotide
  Target: FXN; (-) strand; PAM type: YTN; PAM sequence: TTG
actacttttgactacttcat

SEQ ID NO: 27011 - DNA, 20 bp, Artificial Sequence
  Description of Artificial Sequence: Synthetic oligonucleotide
  Target: FXN; (-) strand; PAM type: YTN; PAM sequence: TTT
gactacttttgactacttca

SEQ ID NO: 27012 - DNA, 20 bp, Artificial Sequence
  Description of Artificial Sequence: Synthetic oligonucleotide
  Target: FXN; (-) strand; PAM type: YTN; PAM sequence: TTT
tgactacttttgactacttc

SEQ ID NO: 27013 - DNA, 20 bp, Artificial Sequence
  Description of Artificial Sequence: Synthetic oligonucleotide
  Target: FXN; (-) strand; PAM type: YTN; PAM sequence: TTT
ttgactacttttgactactt

SEQ ID NO: 27014 - DNA, 20 bp, Artificial Sequence
  Description of Artificial Sequence: Synthetic oligonucleotide
  Target: FXN; (-) strand; PAM type: YTN; PAM sequence: CTG
tgatttttgactacttttga

SEQ ID NO: 27015 - DNA, 20 bp, Artificial Sequence
  Description of Artificial Sequence: Synthetic oligonucleotide
  Target: FXN; (-) strand; PAM type: YTN; PAM sequence: TTC
tgtgatttttgactactttt

SEQ ID NO: 27016 - DNA, 20 bp, Artificial Sequence
  Description of Artificial Sequence: Synthetic oligonucleotide
  Target: FXN; (-) strand; PAM type: YTN; PAM sequence: TTT
ctgtgatttttgactacttt

SEQ ID NO: 27017 - DNA, 20 bp, Artificial Sequence
  Description of Artificial Sequence: Synthetic oligonucleotide
  Target: FXN; (-) strand; PAM type: YTN; PAM sequence: TTA
tggtggtgtttctgtgattt

SEQ ID NO: 27018 - DNA, 20 bp, Artificial Sequence
  Description of Artificial Sequence: Synthetic oligonucleotide
  Target: FXN; (-) strand; PAM type: YTN; PAM sequence: TTT
atggtggtgtttctgtgatt

SEQ ID NO: 27019 - DNA, 20 bp, Artificial Sequence
  Description of Artificial Sequence: Synthetic oligonucleotide
  Target: FXN; (-) strand; PAM type: YTN; PAM sequence: TTA
tacatttatggtggtgtttc

SEQ ID NO: 27020 - DNA, 20 bp, Artificial Sequence
  Description of Artificial Sequence: Synthetic oligonucleotide
  Target: FXN; (-) strand; PAM type: YTN; PAM sequence: TTG
aaaataaaaattatacattt

SEQ ID NO: 27021 - DNA, 20 bp, Artificial Sequence
  Description of Artificial Sequence: Synthetic oligonucleotide
  Target: FXN; (-) strand; PAM type: YTN; PAM sequence: TTA
attgaaaataaaaattatac

SEQ ID NO: 27022 - DNA, 20 bp, Artificial Sequence
  Description of Artificial Sequence: Synthetic oligonucleotide
  Target: FXN; (-) strand; PAM type: YTN; PAM sequence: TTT
aattgaaaataaaaattata

SEQ ID NO: 27023 - DNA, 20 bp, Artificial Sequence
  Description of Artificial Sequence: Synthetic oligonucleotide
  Target: FXN; (-) strand; PAM type: YTN; PAM sequence: TTT
taattgaaaataaaaattat

SEQ ID NO: 27024 - DNA, 20 bp, Artificial Sequence
  Description of Artificial Sequence: Synthetic oligonucleotide
  Target: FXN; (-) strand; PAM type: YTN; PAM sequence: TTT
ttaattgaaaataaaaatta

SEQ ID NO: 27025 - DNA, 20 bp, Artificial Sequence
  Description of Artificial Sequence: Synthetic oligonucleotide
  Target: FXN; (-) strand; PAM type: YTN; PAM sequence: TTT
tttaattgaaaataaaaatt

SEQ ID NO: 27026 - DNA, 20 bp, Artificial Sequence
  Description of Artificial Sequence: Synthetic oligonucleotide
  Target: FXN; (-) strand; PAM type: YTN; PAM sequence: TTT
ttttaattgaaaataaaaat

SEQ ID NO: 27027 - DNA, 20 bp, Artificial Sequence
  Description of Artificial Sequence: Synthetic oligonucleotide
  Target: FXN; (-) strand; PAM type: YTN; PAM sequence: CTA
aaaaaaagatgtttttttaa

SEQ ID NO: 27028 - DNA, 20 bp, Artificial Sequence
  Description of Artificial Sequence: Synthetic oligonucleotide
  Target: FXN; (-) strand; PAM type: YTN; PAM sequence: TTG
actaaaaaaaagatgttttt

SEQ ID NO: 27029 - DNA, 20 bp, Artificial Sequence
  Description of Artificial Sequence: Synthetic oligonucleotide
  Target: FXN; (-) strand; PAM type: YTN; PAM sequence: TTT
gactaaaaaaaagatgtttt

SEQ ID NO: 27030 - DNA, 20 bp, Artificial Sequence
  Description of Artificial Sequence: Synthetic oligonucleotide
  Target: FXN; (-) strand; PAM type: YTN; PAM sequence: TTT
tgactaaaaaaaagatgttt

SEQ ID NO: 27031 - DNA, 20 bp, Artificial Sequence
  Description of Artificial Sequence: Synthetic oligonucleotide
  Target: FXN; (-) strand; PAM type: YTN; PAM sequence: CTA
tgattttgactaaaaaaaag

SEQ ID NO: 27032 - DNA, 20 bp, Artificial Sequence
  Description of Artificial Sequence: Synthetic oligonucleotide
  Target: FXN; (-) strand; PAM type: YTN; PAM sequence: TTC
tatgattttgactaaaaaaa

SEQ ID NO: 27033 - DNA, 20 bp, Artificial Sequence
  Description of Artificial Sequence: Synthetic oligonucleotide
  Target: FXN; (-) strand; PAM type: YTN; PAM sequence: TTT
ctatgattttgactaaaaaa

SEQ ID NO: 27034 - DNA, 20 bp, Artificial Sequence
  Description of Artificial Sequence: Synthetic oligonucleotide
  Target: FXN; (-) strand; PAM type: YTN; PAM sequence: CTA
tttctatgattttgactaaa

SEQ ID NO: 27035 - DNA, 20 bp, Artificial Sequence
  Description of Artificial Sequence: Synthetic oligonucleotide
  Target: FXN; (-) strand; PAM type: YTN; PAM sequence: TTC
tatttctatgattttgacta

SEQ ID NO: 27036 - DNA, 20 bp, Artificial Sequence
  Description of Artificial Sequence: Synthetic oligonucleotide
  Target: FXN; (-) strand; PAM type: YTN; PAM sequence: TTT
ctatttctatgattttgact

SEQ ID NO: 27037 - DNA, 20 bp, Artificial Sequence
  Description of Artificial Sequence: Synthetic oligonucleotide
  Target: FXN; (-) strand; PAM type: YTN; PAM sequence: CTT
tctatttctatgattttgac

SEQ ID NO: 27038 - DNA, 20 bp, Artificial Sequence
  Description of Artificial Sequence: Synthetic oligonucleotide
  Target: FXN; (-) strand; PAM type: YTN; PAM sequence: CTA
ctttctatttctatgatttt

SEQ ID NO: 27039 - DNA, 20 bp, Artificial Sequence
  Description of Artificial Sequence: Synthetic oligonucleotide
  Target: FXN; (-) strand; PAM type: YTN; PAM sequence: CTG
tctactttctatttctatga

SEQ ID NO: 27040 - DNA, 20 bp, Artificial Sequence
  Description of Artificial Sequence: Synthetic oligonucleotide
  Target: FXN; (-) strand; PAM type: YTN; PAM sequence: TTA
gtaaccacctgtctactttc

SEQ ID NO: 27041 - DNA, 20 bp, Artificial Sequence
  Description of Artificial Sequence: Synthetic oligonucleotide
  Target: FXN; (-) strand; PAM type: YTN; PAM sequence: CTT
agtaaccacctgtctacttt

SEQ ID NO: 27042 - DNA, 20 bp, Artificial Sequence
  Description of Artificial Sequence: Synthetic oligonucleotide
  Target: FXN; (-) strand; PAM type: YTN; PAM sequence: TTC
cccatcccatagcccttagt

SEQ ID NO: 27043 - DNA, 20 bp, Artificial Sequence
  Description of Artificial Sequence: Synthetic oligonucleotide
  Target: FXN; (-) strand; PAM type: YTN; PAM sequence: TTT
ccccatcccatagcccttag

SEQ ID NO: 27044 - DNA, 20 bp, Artificial Sequence
  Description of Artificial Sequence: Synthetic oligonucleotide
  Target: FXN; (-) strand; PAM type: YTN; PAM sequence: CTA
atttccccatcccatagccc

SEQ ID NO: 27045 - DNA, 20 bp, Artificial Sequence
  Description of Artificial Sequence: Synthetic oligonucleotide
  Target: FXN; (-) strand; PAM type: YTN; PAM sequence: TTA
gacactaatttccccatccc

SEQ ID NO: 27046 - DNA, 20 bp, Artificial Sequence
  Description of Artificial Sequence: Synthetic oligonucleotide
  Target: FXN; (-) strand; PAM type: YTN; PAM sequence: CTA
tgcccattagacactaattt

SEQ ID NO: 27047 - DNA, 20 bp, Artificial Sequence
  Description of Artificial Sequence: Synthetic oligonucleotide
  Target: FXN; (-) strand; PAM type: YTN; PAM sequence: CTC
tatgcccattagacactaat

SEQ ID NO: 27048 - DNA, 20 bp, Artificial Sequence
  Description of Artificial Sequence: Synthetic oligonucleotide
  Target: FXN; (-) strand; PAM type: YTN; PAM sequence: CTG
aaactctatgcccattagac

SEQ ID NO: 27049 - DNA, 20 bp, Artificial Sequence
  Description of Artificial Sequence: Synthetic oligonucleotide
  Target: FXN; (-) strand; PAM type: YTN; PAM sequence: TTG
taacactgaaactctatgcc

SEQ ID NO: 27050 - DNA, 20 bp, Artificial Sequence
  Description of Artificial Sequence: Synthetic oligonucleotide
  Target: FXN; (-) strand; PAM type: YTN; PAM sequence: CTT
gtaacactgaaactctatgc

SEQ ID NO: 27051 - DNA, 20 bp, Artificial Sequence
  Description of Artificial Sequence: Synthetic oligonucleotide
  Target: FXN; (-) strand; PAM type: YTN; PAM sequence: TTC
accttgtaacactgaaactc

SEQ ID NO: 27052 - DNA, 20 bp, Artificial Sequence
  Description of Artificial Sequence: Synthetic oligonucleotide
  Target: FXN; (-) strand; PAM type: YTN; PAM sequence: TTT
caccttgtaacactgaaact

SEQ ID NO: 27053 - DNA, 20 bp, Artificial Sequence
  Description of Artificial Sequence: Synthetic oligonucleotide
  Target: FXN; (-) strand; PAM type: YTN; PAM sequence: TTT
tcaccttgtaacactgaaac

SEQ ID NO: 27054 - DNA, 20 bp, Artificial Sequence
  Description of Artificial Sequence: Synthetic oligonucleotide
  Target: FXN; (-) strand; PAM type: YTN; PAM sequence: CTT
ttcaccttgtaacactgaaa

SEQ ID NO: 27055 - DNA, 20 bp, Artificial Sequence
  Description of Artificial Sequence: Synthetic oligonucleotide
  Target: FXN; (-) strand; PAM type: YTN; PAM sequence: CTA
gaacttttcaccttgtaaca

SEQ ID NO: 27056 - DNA, 20 bp, Artificial Sequence
  Description of Artificial Sequence: Synthetic oligonucleotide
  Target: FXN; (-) strand; PAM type: YTN; PAM sequence: CTC
tagaacttttcaccttgtaa

SEQ ID NO: 27057 - DNA, 20 bp, Artificial Sequence
  Description of Artificial Sequence: Synthetic oligonucleotide
  Target: FXN; (-) strand; PAM type: YTN; PAM sequence: CTG
ggcagcataactctagaact

SEQ ID NO: 27058 - DNA, 20 bp, Artificial Sequence
  Description of Artificial Sequence: Synthetic oligonucleotide
  Target: FXN; (-) strand; PAM type: YTN; PAM sequence: CTG
ctgggcagcataactctaga

SEQ ID NO: 27059 - DNA, 20 bp, Artificial Sequence
  Description of Artificial Sequence: Synthetic oligonucleotide
  Target: FXN; (-) strand; PAM type: YTN; PAM sequence: TTC
acactgctgggcagcataac

SEQ ID NO: 27060 - DNA, 20 bp, Artificial Sequence
  Description of Artificial Sequence: Synthetic oligonucleotide
  Target: FXN; (-) strand; PAM type: YTN; PAM sequence: TTA
agtgtacagaacaataaagt

SEQ ID NO: 27061 - DNA, 20 bp, Artificial Sequence
  Description of Artificial Sequence: Synthetic oligonucleotide
  Target: FXN; (-) strand; PAM type: YTN; PAM sequence: TTA
accatgttaagtgtacagaa

SEQ ID NO: 27062 - DNA, 20 bp, Artificial Sequence
  Description of Artificial Sequence: Synthetic oligonucleotide
  Target: FXN; (-) strand; PAM type: YTN; PAM sequence: TTA
ccatattaaccatgttaagt

SEQ ID NO: 27063 - DNA, 20 bp, Artificial Sequence
  Description of Artificial Sequence: Synthetic oligonucleotide
  Target: FXN; (-) strand; PAM type: YTN; PAM sequence: TTT
accatattaaccatgttaag

SEQ ID NO: 27064 - DNA, 20 bp, Artificial Sequence
  Description of Artificial Sequence: Synthetic oligonucleotide
  Target: FXN; (-) strand; PAM type: YTN; PAM sequence: CTA
aatttaccatattaaccatg

SEQ ID NO: 27065 - DNA, 20 bp, Artificial Sequence
  Description of Artificial Sequence: Synthetic oligonucleotide
  Target: FXN; (-) strand; PAM type: YTN; PAM sequence: CTA
tagtaaaaagcacataacgc

SEQ ID NO: 27066 - DNA, 20 bp, Artificial Sequence
  Description of Artificial Sequence: Synthetic oligonucleotide
  Target: FXN; (-) strand; PAM type: YTN; PAM sequence: TTA
ctatagtaaaaagcacataa

SEQ ID NO: 27067 - DNA, 20 bp, Artificial Sequence
  Description of Artificial Sequence: Synthetic oligonucleotide
  Target: FXN; (-) strand; PAM type: YTN; PAM sequence: TTT
actatagtaaaaagcacata

SEQ ID NO: 27068 - DNA, 20 bp, Artificial Sequence
  Description of Artificial Sequence: Synthetic oligonucleotide
  Target: FXN; (-) strand; PAM type: YTN; PAM sequence: TTT
tactatagtaaaaagcacat

SEQ ID NO: 27069 - DNA, 20 bp, Artificial Sequence
  Description of Artificial Sequence: Synthetic oligonucleotide
  Target: FXN; (-) strand; PAM type: YTN; PAM sequence: TTA
attttactatagtaaaaagc

SEQ ID NO: 27070 - DNA, 20 bp, Artificial Sequence
  Description of Artificial Sequence: Synthetic oligonucleotide
  Target: FXN; (-) strand; PAM type: YTN; PAM sequence: TTT
aattttactatagtaaaaag

SEQ ID NO: 27071 - DNA, 20 bp, Artificial Sequence
  Description of Artificial Sequence: Synthetic oligonucleotide
  Target: FXN; (-) strand; PAM type: YTN; PAM sequence: TTT
taattttactatagtaaaaa

SEQ ID NO: 27072 - DNA, 20 bp, Artificial Sequence
  Description of Artificial Sequence: Synthetic oligonucleotide
  Target: FXN; (-) strand; PAM type: YTN; PAM sequence: TTT
ttaattttactatagtaaaa

SEQ ID NO: 27073 - DNA, 20 bp, Artificial Sequence
  Description of Artificial Sequence: Synthetic oligonucleotide
  Target: FXN; (-) strand; PAM type: YTN; PAM sequence: TTT
tttaattttactatagtaaa

SEQ ID NO: 27074 - DNA, 20 bp, Artificial Sequence
  Description of Artificial Sequence: Synthetic oligonucleotide
  Target: FXN; (-) strand; PAM type: YTN; PAM sequence: TTT
ttttaattttactatagtaa

SEQ ID NO: 27075 - DNA, 20 bp, Artificial Sequence
  Description of Artificial Sequence: Synthetic oligonucleotide
  Target: FXN; (-) strand; PAM type: YTN; PAM sequence: TTT
tttttaattttactatagta

SEQ ID NO: 27076 - DNA, 20 bp, Artificial Sequence
  Description of Artificial Sequence: Synthetic oligonucleotide
  Target: FXN; (-) strand; PAM type: YTN; PAM sequence: TTT
ttttttaattttactatagt

SEQ ID NO: 27077 - DNA, 20 bp, Artificial Sequence
  Description of Artificial Sequence: Synthetic oligonucleotide
  Target: FXN; (-) strand; PAM type: YTN; PAM sequence: TTT
tttttttaattttactatag

SEQ ID NO: 27078 - DNA, 20 bp, Artificial Sequence
  Description of Artificial Sequence: Synthetic oligonucleotide
  Target: FXN; (-) strand; PAM type: YTN; PAM sequence: TTT
ttttttttaattttactata

SEQ ID NO: 27079 - DNA, 20 bp, Artificial Sequence
  Description of Artificial Sequence: Synthetic oligonucleotide
  Target: FXN; (-) strand; PAM type: YTN; PAM sequence: TTT
tttttttttaattttactat

SEQ ID NO: 27080 - DNA, 20 bp, Artificial Sequence
  Description of Artificial Sequence: Synthetic oligonucleotide
  Target: FXN; (-) strand; PAM type: YTN; PAM sequence: TTT
ttttttttttaattttacta

SEQ ID NO: 27081 - DNA, 20 bp, Artificial Sequence
  Description of Artificial Sequence: Synthetic oligonucleotide
  Target: FXN; (-) strand; PAM type: YTN; PAM sequence: TTT
tttttttttttaattttact

SEQ ID NO: 27082 - DNA, 20 bp, Artificial Sequence
  Description of Artificial Sequence: Synthetic oligonucleotide
  Target: FXN; (-) strand; PAM type: YTN; PAM sequence: CTC
ggccccattttttttttttt

SEQ ID NO: 27083 - DNA, 20 bp, Artificial Sequence
  Description of Artificial Sequence: Synthetic oligonucleotide
  Target: FXN; (-) strand; PAM type: YTN; PAM sequence: CTG
cactcggccccatttttttt

SEQ ID NO: 27084 - DNA, 20 bp, Artificial Sequence
  Description of Artificial Sequence: Synthetic oligonucleotide
  Target: FXN; (-) strand; PAM type: YTN; PAM sequence: CTA
ctgcactcggccccattttt

SEQ ID NO: 27085 - DNA, 20 bp, Artificial Sequence
  Description of Artificial Sequence: Synthetic oligonucleotide
  Target: FXN; (-) strand; PAM type: YTN; PAM sequence: TTA
caggtgtgagctactgcact

SEQ ID NO: 27086 - DNA, 20 bp, Artificial Sequence
  Description of Artificial Sequence: Synthetic oligonucleotide
  Target: FXN; (-) strand; PAM type: YTN; PAM sequence: TTA
tgttacaggtgtgagctact

SEQ ID NO: 27087 - DNA, 20 bp, Artificial Sequence
  Description of Artificial Sequence: Synthetic oligonucleotide
  Target: FXN; (-) strand; PAM type: YTN; PAM sequence: CTG
ggattatgttacaggtgtga

SEQ ID NO: 27088 - DNA, 20 bp, Artificial Sequence
  Description of Artificial Sequence: Synthetic oligonucleotide
  Target: FXN; (-) strand; PAM type: YTN; PAM sequence: CTC
ccaaagtgctgggattatgt

SEQ ID NO: 27089 - DNA, 20 bp, Artificial Sequence
  Description of Artificial Sequence: Synthetic oligonucleotide
  Target: FXN; (-) strand; PAM type: YTN; PAM sequence: CTC
ggcctcccaaagtgctggga

SEQ ID NO: 27090 - DNA, 20 bp, Artificial Sequence
  Description of Artificial Sequence: Synthetic oligonucleotide
  Target: FXN; (-) strand; PAM type: YTN; PAM sequence: CTA
cctcggcctcccaaagtgct

SEQ ID NO: 27091 - DNA, 20 bp, Artificial Sequence
  Description of Artificial Sequence: Synthetic oligonucleotide
  Target: FXN; (-) strand; PAM type: YTN; PAM sequence: CTC
ctacctcggcctcccaaagt

SEQ ID NO: 27092 - DNA, 20 bp, Artificial Sequence
  Description of Artificial Sequence: Synthetic oligonucleotide
  Target: FXN; (-) strand; PAM type: YTN; PAM sequence: CTC
aagtgatcctcctacctcgg

SEQ ID NO: 27093 - DNA, 20 bp, Artificial Sequence
  Description of Artificial Sequence: Synthetic oligonucleotide
  Target: FXN; (-) strand; PAM type: YTN; PAM sequence: CTG
gcctcaagtgatcctcctac

SEQ ID NO: 27094 - DNA, 20 bp, Artificial Sequence
  Description of Artificial Sequence: Synthetic oligonucleotide
  Target: FXN; (-) strand; PAM type: YTN; PAM sequence: TTC
tggcctcaagtgatcctcct

SEQ ID NO: 27095 - DNA, 20 bp, Artificial Sequence
  Description of Artificial Sequence: Synthetic oligonucleotide
  Target: FXN; (-) strand; PAM type: YTN; PAM sequence: CTT
ctggcctcaagtgatcctcc

SEQ ID NO: 27096 - DNA, 20 bp, Artificial Sequence
  Description of Artificial Sequence: Synthetic oligonucleotide
  Target: FXN; (-) strand; PAM type: YTN; PAM sequence: TTC
aaacttctggcctcaagtga

SEQ ID NO: 27097 - DNA, 20 bp, Artificial Sequence
  Description of Artificial Sequence: Synthetic oligonucleotide
  Target: FXN; (-) strand; PAM type: YTN; PAM sequence: TTT
caaacttctggcctcaagtg

SEQ ID NO: 27098 - DNA, 20 bp, Artificial Sequence
  Description of Artificial Sequence: Synthetic oligonucleotide
  Target: FXN; (-) strand; PAM type: YTN; PAM sequence: CTG
gtttcaaacttctggcctca

SEQ ID NO: 27099 - DNA, 20 bp, Artificial Sequence
  Description of Artificial Sequence: Synthetic oligonucleotide
  Target: FXN; (-) strand; PAM type: YTN; PAM sequence: TTG
accaggctggtttcaaactt

SEQ ID NO: 27100 - DNA, 20 bp, Artificial Sequence
  Description of Artificial Sequence: Synthetic oligonucleotide
  Target: FXN; (-) strand; PAM type: YTN; PAM sequence: CTA
tattgaccaggctggtttca

SEQ ID NO: 27101 - DNA, 20 bp, Artificial Sequence
  Description of Artificial Sequence: Synthetic oligonucleotide
  Target: FXN; (-) strand; PAM type: YTN; PAM sequence: CTC
gctatattgaccaggctggt

SEQ ID NO: 27102 - DNA, 20 bp, Artificial Sequence
  Description of Artificial Sequence: Synthetic oligonucleotide
  Target: FXN; (-) strand; PAM type: YTN; PAM sequence: TTG
tagagatgaggtctcgctat

SEQ ID NO: 27103 - DNA, 20 bp, Artificial Sequence
  Description of Artificial Sequence: Synthetic oligonucleotide
  Target: FXN; (-) strand; PAM type: YTN; PAM sequence: TTT
gtagagatgaggtctcgcta

SEQ ID NO: 27104 - DNA, 20 bp, Artificial Sequence
  Description of Artificial Sequence: Synthetic oligonucleotide
  Target: FXN; (-) strand; PAM type: YTN; PAM sequence: TTT
tgtagagatgaggtctcgct

SEQ ID NO: 27105 - DNA, 20 bp, Artificial Sequence
  Description of Artificial Sequence: Synthetic oligonucleotide
  Target: FXN; (-) strand; PAM type: YTN; PAM sequence: CTT
ttgtagagatgaggtctcgc

SEQ ID NO: 27106 - DNA, 20 bp, Artificial Sequence
  Description of Artificial Sequence: Synthetic oligonucleotide
  Target: FXN; (-) strand; PAM type: YTN; PAM sequence: TTC
ttttgtagagatgaggtctc

SEQ ID NO: 27107 - DNA, 20 bp, Artificial Sequence
  Description of Artificial Sequence: Synthetic oligonucleotide
  Target: FXN; (-) strand; PAM type: YTN; PAM sequence: TTT
cttttgtagagatgaggtct

SEQ ID NO: 27108 - DNA, 20 bp, Artificial Sequence
  Description of Artificial Sequence: Synthetic oligonucleotide
  Target: FXN; (-) strand; PAM type: YTN; PAM sequence: TTT
tcttttgtagagatgaggtc

SEQ ID NO: 27109 - DNA, 20 bp, Artificial Sequence
  Description of Artificial Sequence: Synthetic oligonucleotide
  Target: FXN; (-) strand; PAM type: YTN; PAM sequence: TTT
ttcttttgtagagatgaggt

SEQ ID NO: 27110 - DNA, 20 bp, Artificial Sequence
  Description of Artificial Sequence: Synthetic oligonucleotide
  Target: FXN; (-) strand; PAM type: YTN; PAM sequence: TTA
acatttttcttttgtagaga

SEQ ID NO: 27111 - DNA, 20 bp, Artificial Sequence
  Description of Artificial Sequence: Synthetic oligonucleotide
  Target: FXN; (-) strand; PAM type: YTN; PAM sequence: TTT
aacatttttcttttgtagag

SEQ ID NO: 27112 - DNA, 20 bp, Artificial Sequence
  Description of Artificial Sequence: Synthetic oligonucleotide
  Target: FXN; (-) strand; PAM type: YTN; PAM sequence: TTT
taacatttttcttttgtaga

SEQ ID NO: 27113 - DNA, 20 bp, Artificial Sequence
  Description of Artificial Sequence: Synthetic oligonucleotide
  Target: FXN; (-) strand; PAM type: YTN; PAM sequence: CTA
attttaacatttttcttttg

SEQ ID NO: 27114 - DNA, 20 bp, Artificial Sequence
  Description of Artificial Sequence: Synthetic oligonucleotide
  Target: FXN; (-) strand; PAM type: YTN; PAM sequence: CTG
tctaattttaacatttttct

SEQ ID NO: 27115 - DNA, 20 bp, Artificial Sequence
  Description of Artificial Sequence: Synthetic oligonucleotide
  Target: FXN; (-) strand; PAM type: YTN; PAM sequence: CTA
cagacaccacacctgtctaa

SEQ ID NO: 27116 - DNA, 20 bp, Artificial Sequence
  Description of Artificial Sequence: Synthetic oligonucleotide
  Target: FXN; (-) strand; PAM type: YTN; PAM sequence: CTG
ggactacagacaccacacct

SEQ ID NO: 27117 - DNA, 20 bp, Artificial Sequence
  Description of Artificial Sequence: Synthetic oligonucleotide
  Target: FXN; (-) strand; PAM type: YTN; PAM sequence: CTC
cagagagctgggactacaga

SEQ ID NO: 27118 - DNA, 20 bp, Artificial Sequence
  Description of Artificial Sequence: Synthetic oligonucleotide
  Target: FXN; (-) strand; PAM type: YTN; PAM sequence: CTG
cctccagagagctgggacta

SEQ ID NO: 27119 - DNA, 20 bp, Artificial Sequence
  Description of Artificial Sequence: Synthetic oligonucleotide
  Target: FXN; (-) strand; PAM type: YTN; PAM sequence: CTC
agtccctgcctccagagagc

SEQ ID NO: 27120 - DNA, 20 bp, Artificial Sequence
  Description of Artificial Sequence: Synthetic oligonucleotide
  Target: FXN; (-) strand; PAM type: YTN; PAM sequence: CTG
actcagtccctgcctccaga

SEQ ID NO: 27121 - DNA, 20 bp, Artificial Sequence
  Description of Artificial Sequence: Synthetic oligonucleotide
  Target: FXN; (-) strand; PAM type: YTN; PAM sequence: CTC
tgactcagtccctgcctcca

SEQ ID NO: 27122 - DNA, 20 bp, Artificial Sequence
  Description of Artificial Sequence: Synthetic oligonucleotide
  Target: FXN; (-) strand; PAM type: YTN; PAM sequence: CTC
aagtgatcctctgactcagt

SEQ ID NO: 27123 - DNA, 20 bp, Artificial Sequence
  Description of Artificial Sequence: Synthetic oligonucleotide
  Target: FXN; (-) strand; PAM type: YTN; PAM sequence: CTA
tgctcaagtgatcctctgac

SEQ ID NO: 27124 - DNA, 20 bp, Artificial Sequence
  Description of Artificial Sequence: Synthetic oligonucleotide
  Target: FXN; (-) strand; PAM type: YTN; PAM sequence: CTC
aaacccctatgctcaagtga

SEQ ID NO: 27125 - DNA, 20 bp, Artificial Sequence
  Description of Artificial Sequence: Synthetic oligonucleotide
  Target: FXN; (-) strand; PAM type: YTN; PAM sequence: CTG
cagcctcaaacccctatgct

SEQ ID NO: 27126 - DNA, 20 bp, Artificial Sequence
  Description of Artificial Sequence: Synthetic oligonucleotide
  Target: FXN; (-) strand; PAM type: YTN; PAM sequence: CTC
actgcagcctcaaaccccta

SEQ ID NO: 27127 - DNA, 20 bp, Artificial Sequence
  Description of Artificial Sequence: Synthetic oligonucleotide
  Target: FXN; (-) strand; PAM type: YTN; PAM sequence: CTG
cagcagtggcaggatcatgg

SEQ ID NO: 27128 - DNA, 20 bp, Artificial Sequence
  Description of Artificial Sequence: Synthetic oligonucleotide
  Target: FXN; (-) strand; PAM type: YTN; PAM sequence: CTC
aggctgcagcagtggcagga

SEQ ID NO: 27129 - DNA, 20 bp, Artificial Sequence
  Description of Artificial Sequence: Synthetic oligonucleotide
  Target: FXN; (-) strand; PAM type: YTN; PAM sequence: TTG
ctcaggctgcagcagtggca

SEQ ID NO: 27130 - DNA, 20 bp, Artificial Sequence
  Description of Artificial Sequence: Synthetic oligonucleotide
  Target: FXN; (-) strand; PAM type: YTN; PAM sequence: CTG
ttgctcaggctgcagcagtg

SEQ ID NO: 27131 - DNA, 20 bp, Artificial Sequence
  Description of Artificial Sequence: Synthetic oligonucleotide
  Target: FXN; (-) strand; PAM type: YTN; PAM sequence: CTC
tgttgctcaggctgcagcag

SEQ ID NO: 27132 - DNA, 20 bp, Artificial Sequence
  Description of Artificial Sequence: Synthetic oligonucleotide
  Target: FXN; (-) strand; PAM type: YTN; PAM sequence: TTG
ctctgttgctcaggctgcag

SEQ ID NO: 27133 - DNA, 20 bp, Artificial Sequence
  Description of Artificial Sequence: Synthetic oligonucleotide
  Target: FXN; (-) strand; PAM type: YTN; PAM sequence: CTT
gctctgttgctcaggctgca

SEQ ID NO: 27134 - DNA, 20 bp, Artificial Sequence
  Description of Artificial Sequence: Synthetic oligonucleotide
  Target: FXN; (-) strand; PAM type: YTN; PAM sequence: TTA
caacagggtcttgctctgtt

SEQ ID NO: 27135 - DNA, 20 bp, Artificial Sequence
  Description of Artificial Sequence: Synthetic oligonucleotide
  Target: FXN; (-) strand; PAM type: YTN; PAM sequence: TTT
acaacagggtcttgctctgt

SEQ ID NO: 27136 - DNA, 20 bp, Artificial Sequence
  Description of Artificial Sequence: Synthetic oligonucleotide
  Target: FXN; (-) strand; PAM type: YTN; PAM sequence: TTT
tacaacagggtcttgctctg

SEQ ID NO: 27137 - DNA, 20 bp, Artificial Sequence
  Description of Artificial Sequence: Synthetic oligonucleotide
  Target: FXN; (-) strand; PAM type: YTN; PAM sequence: TTT
ttacaacagggtcttgctct

SEQ ID NO: 27138 - DNA, 20 bp, Artificial Sequence
  Description of Artificial Sequence: Synthetic oligonucleotide
  Target: FXN; (-) strand; PAM type: YTN; PAM sequence: TTG
tttttacaacagggtcttgc

SEQ ID NO: 27139 - DNA, 20 bp, Artificial Sequence
  Description of Artificial Sequence: Synthetic oligonucleotide
  Target: FXN; (-) strand; PAM type: YTN; PAM sequence: TTT
gtttttacaacagggtcttg

SEQ ID NO: 27140 - DNA, 20 bp, Artificial Sequence
  Description of Artificial Sequence: Synthetic oligonucleotide
  Target: FXN; (-) strand; PAM type: YTN; PAM sequence: TTG
tttgtttttacaacagggtc

SEQ ID NO: 27141 - DNA, 20 bp, Artificial Sequence
  Description of Artificial Sequence: Synthetic oligonucleotide
  Target: FXN; (-) strand; PAM type: YTN; PAM sequence: TTT
gtttgtttttacaacagggt

SEQ ID NO: 27142 - DNA, 20 bp, Artificial Sequence
  Description of Artificial Sequence: Synthetic oligonucleotide
  Target: FXN; (-) strand; PAM type: YTN; PAM sequence: TTG
tttgtttgtttttacaacag

SEQ ID NO: 27143 - DNA, 20 bp, Artificial Sequence
  Description of Artificial Sequence: Synthetic oligonucleotide
  Target: FXN; (-) strand; PAM type: YTN; PAM sequence: TTT
gtttgtttgtttttacaaca

SEQ ID NO: 27144 - DNA, 20 bp, Artificial Sequence
  Description of Artificial Sequence: Synthetic oligonucleotide
  Target: FXN; (-) strand; PAM type: YTN; PAM sequence: TTT
tgtttgtttgtttttacaac

SEQ ID NO: 27145 - DNA, 20 bp, Artificial Sequence
  Description of Artificial Sequence: Synthetic oligonucleotide
  Target: FXN; (-) strand; PAM type: YTN; PAM sequence: TTT
ttgtttgtttgtttttacaa

SEQ ID NO: 27146 - DNA, 20 bp, Artificial Sequence
  Description of Artificial Sequence: Synthetic oligonucleotide
  Target: FXN; (-) strand; PAM type: YTN; PAM sequence: CTG
ccagtttttgtttgtttgtt

SEQ ID NO: 27147 - DNA, 20 bp, Artificial Sequence
  Description of Artificial Sequence: Synthetic oligonucleotide
  Target: FXN; (-) strand; PAM type: YTN; PAM sequence: CTC
aggtatcagctgccagtttt

SEQ ID NO: 27148 - DNA, 20 bp, Artificial Sequence
  Description of Artificial Sequence: Synthetic oligonucleotide
  Target: FXN; (-) strand; PAM type: YTN; PAM sequence: CTC
tcaggtatcagctgccagtt

SEQ ID NO: 27149 - DNA, 20 bp, Artificial Sequence
  Description of Artificial Sequence: Synthetic oligonucleotide
  Target: FXN; (-) strand; PAM type: YTN; PAM sequence: TTC
actctcaggtatcagctgcc

SEQ ID NO: 27150 - DNA, 20 bp, Artificial Sequence
  Description of Artificial Sequence: Synthetic oligonucleotide
  Target: FXN; (-) strand; PAM type: YTN; PAM sequence: TTA
accagcgataaaagatattc

SEQ ID NO: 27151 - DNA, 20 bp, Artificial Sequence
  Description of Artificial Sequence: Synthetic oligonucleotide
  Target: FXN; (-) strand; PAM type: YTN; PAM sequence: CTC
aatcccattaaccagcgata

SEQ ID NO: 27152 - DNA, 20 bp, Artificial Sequence
  Description of Artificial Sequence: Synthetic oligonucleotide
  Target: FXN; (-) strand; PAM type: YTN; PAM sequence: CTC
tcaatcccattaaccagcga

SEQ ID NO: 27153 - DNA, 20 bp, Artificial Sequence
  Description of Artificial Sequence: Synthetic oligonucleotide
  Target: FXN; (-) strand; PAM type: YTN; PAM sequence: TTC
tctcaatcccattaaccagc

SEQ ID NO: 27154 - DNA, 20 bp, Artificial Sequence
  Description of Artificial Sequence: Synthetic oligonucleotide
  Target: FXN; (-) strand; PAM type: YTN; PAM sequence: CTA
taagatgaagcattctctca

SEQ ID NO: 27155 - DNA, 20 bp, Artificial Sequence
  Description of Artificial Sequence: Synthetic oligonucleotide
  Target: FXN; (-) strand; PAM type: YTN; PAM sequence: TTC
tataagatgaagcattctct

SEQ ID NO: 27156 - DNA, 20 bp, Artificial Sequence
  Description of Artificial Sequence: Synthetic oligonucleotide
  Target: FXN; (-) strand; PAM type: YTN; PAM sequence: TTT
ctataagatgaagcattctc

SEQ ID NO: 27157 - DNA, 20 bp, Artificial Sequence
  Description of Artificial Sequence: Synthetic oligonucleotide
  Target: FXN; (-) strand; PAM type: YTN; PAM sequence: CTT
tctataagatgaagcattct

SEQ ID NO: 27158 - DNA, 20 bp, Artificial Sequence
  Description of Artificial Sequence: Synthetic oligonucleotide
  Target: FXN; (-) strand; PAM type: YTN; PAM sequence: TTC
tttctataagatgaagcatt

SEQ ID NO: 27159 - DNA, 20 bp, Artificial Sequence
  Description of Artificial Sequence: Synthetic oligonucleotide
  Target: FXN; (-) strand; PAM type: YTN; PAM sequence: CTG
ttctttctataagatgaagc

SEQ ID NO: 27160 - DNA, 20 bp, Artificial Sequence
  Description of Artificial Sequence: Synthetic oligonucleotide
  Target: FXN; (-) strand; PAM type: YTN; PAM sequence: CTG
tgggtccaaagacactgttc

SEQ ID NO: 27161 - DNA, 20 bp, Artificial Sequence
  Description of Artificial Sequence: Synthetic oligonucleotide
  Target: FXN; (-) strand; PAM type: YTN; PAM sequence: CTC
tgtgggtccaaagacactgt

SEQ ID NO: 27162 - DNA, 20 bp, Artificial Sequence
  Description of Artificial Sequence: Synthetic oligonucleotide
  Target: FXN; (-) strand; PAM type: YTN; PAM sequence: TTA
aatccaggtctctgtgggtc

SEQ ID NO: 27163 - DNA, 20 bp, Artificial Sequence
  Description of Artificial Sequence: Synthetic oligonucleotide
  Target: FXN; (-) strand; PAM type: YTN; PAM sequence: CTT
aaatccaggtctctgtgggt

SEQ ID NO: 27164 - DNA, 20 bp, Artificial Sequence
  Description of Artificial Sequence: Synthetic oligonucleotide
  Target: FXN; (-) strand; PAM type: YTN; PAM sequence: CTA
atcttaaatccaggtctctg

SEQ ID NO: 27165 - DNA, 20 bp, Artificial Sequence
  Description of Artificial Sequence: Synthetic oligonucleotide
  Target: FXN; (-) strand; PAM type: YTN; PAM sequence: TTG
gcagagctaatcttaaatcc

SEQ ID NO: 27166 - DNA, 20 bp, Artificial Sequence
  Description of Artificial Sequence: Synthetic oligonucleotide
  Target: FXN; (-) strand; PAM type: YTN; PAM sequence: CTC
agtaattggcagagctaatc

SEQ ID NO: 27167 - DNA, 20 bp, Artificial Sequence
  Description of Artificial Sequence: Synthetic oligonucleotide
  Target: FXN; (-) strand; PAM type: YTN; PAM sequence: TTC
atagtaaagagtactcagta

SEQ ID NO: 27168 - DNA, 20 bp, Artificial Sequence
  Description of Artificial Sequence: Synthetic oligonucleotide
  Target: FXN; (-) strand; PAM type: YTN; PAM sequence: TTC
acagatgaggaaaacagagg

SEQ ID NO: 27169 - DNA, 20 bp, Artificial Sequence
  Description of Artificial Sequence: Synthetic oligonucleotide
  Target: FXN; (-) strand; PAM type: YTN; PAM sequence: TTT
cacagatgaggaaaacagag

SEQ ID NO: 27170 - DNA, 20 bp, Artificial Sequence
  Description of Artificial Sequence: Synthetic oligonucleotide
  Target: FXN; (-) strand; PAM type: YTN; PAM sequence: TTC
cagtttcacagatgaggaaa

SEQ ID NO: 27171 - DNA, 20 bp, Artificial Sequence
  Description of Artificial Sequence: Synthetic oligonucleotide
  Target: FXN; (-) strand; PAM type: YTN; PAM sequence: TTA
ttccagtttcacagatgagg

SEQ ID NO: 27172 - DNA, 20 bp, Artificial Sequence
  Description of Artificial Sequence: Synthetic oligonucleotide
  Target: FXN; (-) strand; PAM type: YTN; PAM sequence: TTC
attattccagtttcacagat

SEQ ID NO: 27173 - DNA, 20 bp, Artificial Sequence
  Description of Artificial Sequence: Synthetic oligonucleotide
  Target: FXN; (-) strand; PAM type: YTN; PAM sequence: TTG
gcggtaggattcattattcc

SEQ ID NO: 27174 - DNA, 20 bp, Artificial Sequence
  Description of Artificial Sequence: Synthetic oligonucleotide
  Target: FXN; (-) strand; PAM type: YTN; PAM sequence: TTG
ttggcggtaggattcattat

SEQ ID NO: 27175 - DNA, 20 bp, Artificial Sequence
  Description of Artificial Sequence: Synthetic oligonucleotide
  Target: FXN; (-) strand; PAM type: YTN; PAM sequence: CTA
caattgttggcggtaggatt

SEQ ID NO: 27176 - DNA, 20 bp, Artificial Sequence
  Description of Artificial Sequence: Synthetic oligonucleotide
  Target: FXN; (-) strand; PAM type: YTN; PAM sequence: TTG
actacaattgttggcggtag

SEQ ID NO: 27177 - DNA, 20 bp, Artificial Sequence
  Description of Artificial Sequence: Synthetic oligonucleotide
  Target: FXN; (-) strand; PAM type: YTN; PAM sequence: CTT
gactacaattgttggcggta

SEQ ID NO: 27178 - DNA, 20 bp, Artificial Sequence
  Description of Artificial Sequence: Synthetic oligonucleotide
  Target: FXN; (-) strand; PAM type: YTN; PAM sequence: TTC
caacttgactacaattgttg

SEQ ID NO: 27179 - DNA, 20 bp, Artificial Sequence
  Description of Artificial Sequence: Synthetic oligonucleotide
  Target: FXN; (-) strand; PAM type: YTN; PAM sequence: TTT
ccaacttgactacaattgtt

SEQ ID NO: 27180 - DNA, 20 bp, Artificial Sequence
  Description of Artificial Sequence: Synthetic oligonucleotide
  Target: FXN; (-) strand; PAM type: YTN; PAM sequence: TTG
tttccaacttgactacaatt

SEQ ID NO: 27181 - DNA, 20 bp, Artificial Sequence
  Description of Artificial Sequence: Synthetic oligonucleotide
  Target: FXN; (-) strand; PAM type: YTN; PAM sequence: TTG
tgtaaattgtttccaacttg

SEQ ID NO: 27182 - DNA, 20 bp, Artificial Sequence
  Description of Artificial Sequence: Synthetic oligonucleotide
  Target: FXN; (-) strand; PAM type: YTN; PAM sequence: TTT
gtgtaaattgtttccaactt

SEQ ID NO: 27183 - DNA, 20 bp, Artificial Sequence
  Description of Artificial Sequence: Synthetic oligonucleotide
  Target: FXN; (-) strand; PAM type: YTN; PAM sequence: CTT
tgtgtaaattgtttccaact

SEQ ID NO: 27184 - DNA, 20 bp, Artificial Sequence
  Description of Artificial Sequence: Synthetic oligonucleotide
  Target: FXN; (-) strand; PAM type: YTN; PAM sequence: TTG
gcactttgtgtaaattgttt

SEQ ID NO: 27185 - DNA, 20 bp, Artificial Sequence
  Description of Artificial Sequence: Synthetic oligonucleotide
  Target: FXN; (-) strand; PAM type: YTN; PAM sequence: TTT
ggcactttgtgtaaattgtt

SEQ ID NO: 27186 - DNA, 20 bp, Artificial Sequence
  Description of Artificial Sequence: Synthetic oligonucleotide
  Target: FXN; (-) strand; PAM type: YTN; PAM sequence: TTG
gtgtttggcactttgtgtaa

SEQ ID NO: 27187 - DNA, 20 bp, Artificial Sequence
  Description of Artificial Sequence: Synthetic oligonucleotide
  Target: FXN; (-) strand; PAM type: YTN; PAM sequence: CTT
ggtgtttggcactttgtgta

SEQ ID NO: 27188 - DNA, 20 bp, Artificial Sequence
  Description of Artificial Sequence: Synthetic oligonucleotide
  Target: FXN; (-) strand; PAM type: YTN; PAM sequence: CTG
tgccaggcttggtgtttggc

SEQ ID NO: 27189 - DNA, 20 bp, Artificial Sequence
  Description of Artificial Sequence: Synthetic oligonucleotide
  Target: FXN; (-) strand; PAM type: YTN; PAM sequence: CTA
ctgtgccaggcttggtgttt

SEQ ID NO: 27190 - DNA, 20 bp, Artificial Sequence
  Description of Artificial Sequence: Synthetic oligonucleotide
  Target: FXN; (-) strand; PAM type: YTN; PAM sequence: TTC
ctactgtgccaggcttggtg

SEQ ID NO: 27191 - DNA, 20 bp, Artificial Sequence
  Description of Artificial Sequence: Synthetic oligonucleotide
  Target: FXN; (-) strand; PAM type: YTN; PAM sequence: CTC
ggttcctactgtgccaggct

SEQ ID NO: 27192 - DNA, 20 bp, Artificial Sequence
  Description of Artificial Sequence: Synthetic oligonucleotide
  Target: FXN; (-) strand; PAM type: YTN; PAM sequence: TTA
ctcggttcctactgtgccag

SEQ ID NO: 27193 - DNA, 20 bp, Artificial Sequence
  Description of Artificial Sequence: Synthetic oligonucleotide
  Target: FXN; (-) strand; PAM type: YTN; PAM sequence: TTT
actcggttcctactgtgcca

SEQ ID NO: 27194 - DNA, 20 bp, Artificial Sequence
  Description of Artificial Sequence: Synthetic oligonucleotide
  Target: FXN; (-) strand; PAM type: YTN; PAM sequence: CTA
tttactcggttcctactgtg

SEQ ID NO: 27195 - DNA, 20 bp, Artificial Sequence
  Description of Artificial Sequence: Synthetic oligonucleotide
  Target: FXN; (-) strand; PAM type: YTN; PAM sequence: TTA
accactatttactcggttcc

SEQ ID NO: 27196 - DNA, 20 bp, Artificial Sequence
  Description of Artificial Sequence: Synthetic oligonucleotide
  Target: FXN; (-) strand; PAM type: YTN; PAM sequence: CTG
ataaaaatattaaccactat

SEQ ID NO: 27197 - DNA, 20 bp, Artificial Sequence
  Description of Artificial Sequence: Synthetic oligonucleotide
  Target: FXN; (-) strand; PAM type: YTN; PAM sequence: TTC
aaaaacaaatgtatagaaat

SEQ ID NO: 27198 - DNA, 20 bp, Artificial Sequence
  Description of Artificial Sequence: Synthetic oligonucleotide
  Target: FXN; (-) strand; PAM type: YTN; PAM sequence: CTG
attcaaaaacaaatgtatag

SEQ ID NO: 27199 - DNA, 20 bp, Artificial Sequence
  Description of Artificial Sequence: Synthetic oligonucleotide
  Target: FXN; (-) strand; PAM type: YTN; PAM sequence: TTC
tgattcaaaaacaaatgtat

SEQ ID NO: 27200 - DNA, 20 bp, Artificial Sequence
  Description of Artificial Sequence: Synthetic oligonucleotide
  Target: FXN; (-) strand; PAM type: YTN; PAM sequence: TTT
ctgattcaaaaacaaatgta

SEQ ID NO: 27201 - DNA, 20 bp, Artificial Sequence
  Description of Artificial Sequence: Synthetic oligonucleotide
  Target: FXN; (-) strand; PAM type: YTN; PAM sequence: TTT
tctgattcaaaaacaaatgt

SEQ ID NO: 27202 - DNA, 20 bp, Artificial Sequence
  Description of Artificial Sequence: Synthetic oligonucleotide
  Target: FXN; (-) strand; PAM type: YTN; PAM sequence: TTT
ttctgattcaaaaacaaatg

SEQ ID NO: 27203 - DNA, 20 bp, Artificial Sequence
  Description of Artificial Sequence: Synthetic oligonucleotide
  Target: FXN; (-) strand; PAM type: YTN; PAM sequence: CTT
tttctgattcaaaaacaaat

SEQ ID NO: 27204 - DNA, 20 bp, Artificial Sequence
  Description of Artificial Sequence: Synthetic oligonucleotide
  Target: FXN; (-) strand; PAM type: YTN; PAM sequence: TTA
aaataacatctttttctgat

SEQ ID NO: 27205 - DNA, 20 bp, Artificial Sequence
  Description of Artificial Sequence: Synthetic oligonucleotide
  Target: FXN; (-) strand; PAM type: YTN; PAM sequence: TTT
aaaataacatctttttctga

SEQ ID NO: 27206 - DNA, 20 bp, Artificial Sequence
  Description of Artificial Sequence: Synthetic oligonucleotide
  Target: FXN; (-) strand; PAM type: YTN; PAM sequence: TTT
taaaataacatctttttctg

SEQ ID NO: 27207 - DNA, 20 bp, Artificial Sequence
  Description of Artificial Sequence: Synthetic oligonucleotide
  Target: FXN; (-) strand; PAM type: YTN; PAM sequence: TTT
ttaaaataacatctttttct

SEQ ID NO: 27208 - DNA, 20 bp, Artificial Sequence
  Description of Artificial Sequence: Synthetic oligonucleotide
  Target: FXN; (-) strand; PAM type: YTN; PAM sequence: TTT
tttaaaataacatctttttc

SEQ ID NO: 27209 - DNA, 20 bp, Artificial Sequence
  Description of Artificial Sequence: Synthetic oligonucleotide
  Target: FXN; (-) strand; PAM type: YTN; PAM sequence: TTT
ttttaaaataacatcttttt

SEQ ID NO: 27210 - DNA, 20 bp, Artificial Sequence
  Description of Artificial Sequence: Synthetic oligonucleotide
  Target: FXN; (-) strand; PAM type: YTN; PAM sequence: TTA
tttttttaaaataacatctt

SEQ ID NO: 27211 - DNA, 20 bp, Artificial Sequence
  Description of Artificial Sequence: Synthetic oligonucleotide
  Target: FXN; (-) strand; PAM type: YTN; PAM sequence: CTG
ggttatttttttaaaataac

SEQ ID NO: 27212 - DNA, 20 bp, Artificial Sequence
  Description of Artificial Sequence: Synthetic oligonucleotide
  Target: FXN; (-) strand; PAM type: YTN; PAM sequence: CTA
ctgggttatttttttaaaat

SEQ ID NO: 27213 - DNA, 20 bp, Artificial Sequence
  Description of Artificial Sequence: Synthetic oligonucleotide
  Target: FXN; (-) strand; PAM type: YTN; PAM sequence: CTG
ataggaatgggacaaggggc

SEQ ID NO: 27214 - DNA, 20 bp, Artificial Sequence
  Description of Artificial Sequence: Synthetic oligonucleotide
  Target: FXN; (-) strand; PAM type: YTN; PAM sequence: TTC
cagagggtagtaacaataat

SEQ ID NO: 27215 - DNA, 20 bp, Artificial Sequence
  Description of Artificial Sequence: Synthetic oligonucleotide
  Target: FXN; (-) strand; PAM type: YTN; PAM sequence: TTG
aaattccagagggtagtaac

SEQ ID NO: 27216 - DNA, 20 bp, Artificial Sequence
  Description of Artificial Sequence: Synthetic oligonucleotide
  Target: FXN; (-) strand; PAM type: YTN; PAM sequence: TTA
ttgaaattccagagggtagt

SEQ ID NO: 27217 - DNA, 20 bp, Artificial Sequence
  Description of Artificial Sequence: Synthetic oligonucleotide
  Target: FXN; (-) strand; PAM type: YTN; PAM sequence: CTC
aaaagcaaagcaaaacaaaa

SEQ ID NO: 27218 - DNA, 20 bp, Artificial Sequence
  Description of Artificial Sequence: Synthetic oligonucleotide
  Target: FXN; (-) strand; PAM type: YTN; PAM sequence: CTG
tctcaaaagcaaagcaaaac

SEQ ID NO: 27219 - DNA, 20 bp, Artificial Sequence
  Description of Artificial Sequence: Synthetic oligonucleotide
  Target: FXN; (-) strand; PAM type: YTN; PAM sequence: CTG
ggcgacagagatcctgtctc

SEQ ID NO: 27220 - DNA, 20 bp, Artificial Sequence
  Description of Artificial Sequence: Synthetic oligonucleotide
  Target: FXN; (-) strand; PAM type: YTN; PAM sequence: CTA
cacaccagactgggcgacag

SEQ ID NO: 27221 - DNA, 20 bp, Artificial Sequence
  Description of Artificial Sequence: Synthetic oligonucleotide
  Target: FXN; (-) strand; PAM type: YTN; PAM sequence: CTG
agatcacaccactacacacc

SEQ ID NO: 27222 - DNA, 20 bp, Artificial Sequence
  Description of Artificial Sequence: Synthetic oligonucleotide
  Target: FXN; (-) strand; PAM type: YTN; PAM sequence: CTG
cagtgagctgagatcacacc

SEQ ID NO: 27223 - DNA, 20 bp, Artificial Sequence
  Description of Artificial Sequence: Synthetic oligonucleotide
  Target: FXN; (-) strand; PAM type: YTN; PAM sequence: TTG
aggctgcagtgagctgagat

SEQ ID NO: 27224 - DNA, 20 bp, Artificial Sequence
  Description of Artificial Sequence: Synthetic oligonucleotide
  Target: FXN; (-) strand; PAM type: YTN; PAM sequence: CTG
agcccaggaggttgaggctg

SEQ ID NO: 27225 - DNA, 20 bp, Artificial Sequence
  Description of Artificial Sequence: Synthetic oligonucleotide
  Target: FXN; (-) strand; PAM type: YTN; PAM sequence: CTG
aagtgggaggatcacctgag

SEQ ID NO: 27226 - DNA, 20 bp, Artificial Sequence
  Description of Artificial Sequence: Synthetic oligonucleotide
  Target: FXN; (-) strand; PAM type: YTN; PAM sequence: TTG
ggaggctgaagtgggaggat

SEQ ID NO: 27227 - DNA, 20 bp, Artificial Sequence
  Description of Artificial Sequence: Synthetic oligonucleotide
  Target: FXN; (-) strand; PAM type: YTN; PAM sequence: CTT
gggaggctgaagtgggagga

SEQ ID NO: 27228 - DNA, 20 bp, Artificial Sequence
  Description of Artificial Sequence: Synthetic oligonucleotide
  Target: FXN; (-) strand; PAM type: YTN; PAM sequence: CTA
cttgggaggctgaagtggga

SEQ ID NO: 27229 - DNA, 20 bp, Artificial Sequence
  Description of Artificial Sequence: Synthetic oligonucleotide
  Target: FXN; (-) strand; PAM type: YTN; PAM sequence: CTG
tggtcccagctacttgggag

SEQ ID NO: 27230 - DNA, 20 bp, Artificial Sequence
  Description of Artificial Sequence: Synthetic oligonucleotide
  Target: FXN; (-) strand; PAM type: YTN; PAM sequence: TTA
gccaagtgtggtggcatgcg

SEQ ID NO: 27231 - DNA, 20 bp, Artificial Sequence
  Description of Artificial Sequence: Synthetic oligonucleotide
  Target: FXN; (-) strand; PAM type: YTN; PAM sequence: CTA
aaaatgcaaaaattagccaa

SEQ ID NO: 27232 - DNA, 20 bp, Artificial Sequence
  Description of Artificial Sequence: Synthetic oligonucleotide
  Target: FXN; (-) strand; PAM type: YTN; PAM sequence: CTA
ctaaaaatgcaaaaattagc

SEQ ID NO: 27233 - DNA, 20 bp, Artificial Sequence
  Description of Artificial Sequence: Synthetic oligonucleotide
  Target: FXN; (-) strand; PAM type: YTN; PAM sequence: CTC
tactaaaaatgcaaaaatta

SEQ ID NO: 27234 - DNA, 20 bp, Artificial Sequence
  Description of Artificial Sequence: Synthetic oligonucleotide
  Target: FXN; (-) strand; PAM type: YTN; PAM sequence: CTG
tctctactaaaaatgcaaaa

SEQ ID NO: 27235 - DNA, 20 bp, Artificial Sequence
  Description of Artificial Sequence: Synthetic oligonucleotide
  Target: FXN; (-) strand; PAM type: YTN; PAM sequence: CTA
ggcaatatggcaaaaccctg

SEQ ID NO: 27236 - DNA, 20 bp, Artificial Sequence
  Description of Artificial Sequence: Synthetic oligonucleotide
  Target: FXN; (-) strand; PAM type: YTN; PAM sequence: TTC
cagaccggcctaggcaatat

SEQ ID NO: 27237 - DNA, 20 bp, Artificial Sequence
  Description of Artificial Sequence: Synthetic oligonucleotide
  Target: FXN; (-) strand; PAM type: YTN; PAM sequence: TTG
agcccagaagttccagaccg

SEQ ID NO: 27238 - DNA, 20 bp, Artificial Sequence
  Description of Artificial Sequence: Synthetic oligonucleotide
  Target: FXN; (-) strand; PAM type: YTN; PAM sequence: CTT
gagcccagaagttccagacc

SEQ ID NO: 27239 - DNA, 20 bp, Artificial Sequence
  Description of Artificial Sequence: Synthetic oligonucleotide
  Target: FXN; (-) strand; PAM type: YTN; PAM sequence: TTG
ggaggccgaggcaggcagat

SEQ ID NO: 27240 - DNA, 20 bp, Artificial Sequence
  Description of Artificial Sequence: Synthetic oligonucleotide
  Target: FXN; (-) strand; PAM type: YTN; PAM sequence: TTT
gggaggccgaggcaggcaga

SEQ ID NO: 27241 - DNA, 20 bp, Artificial Sequence
  Description of Artificial Sequence: Synthetic oligonucleotide
  Target: FXN; (-) strand; PAM type: YTN; PAM sequence: CTT
tgggaggccgaggcaggcag

SEQ ID NO: 27242 - DNA, 20 bp, Artificial Sequence
  Description of Artificial Sequence: Synthetic oligonucleotide
  Target: FXN; (-) strand; PAM type: YTN; PAM sequence: TTC
cagcactttgggaggccgag

SEQ ID NO: 27243 - DNA, 20 bp, Artificial Sequence
  Description of Artificial Sequence: Synthetic oligonucleotide
  Target: FXN; (-) strand; PAM type: YTN; PAM sequence: CTG
aaattccagcactttgggag

SEQ ID NO: 27244 - DNA, 20 bp, Artificial Sequence
  Description of Artificial Sequence: Synthetic oligonucleotide
  Target: FXN; (-) strand; PAM type: YTN; PAM sequence: CTC
atgcctgaaattccagcact

SEQ ID NO: 27245 - DNA, 20 bp, Artificial Sequence
  Description of Artificial Sequence: Synthetic oligonucleotide
  Target: FXN; (-) strand; PAM type: YTN; PAM sequence: TTA
ggccaggcatggctcatgcc

SEQ ID NO: 27246 - DNA, 20 bp, Artificial Sequence
  Description of Artificial Sequence: Synthetic oligonucleotide
  Target: FXN; (-) strand; PAM type: YTN; PAM sequence: TTT
aggccaggcatggctcatgc

SEQ ID NO: 27247 - DNA, 20 bp, Artificial Sequence
  Description of Artificial Sequence: Synthetic oligonucleotide
  Target: FXN; (-) strand; PAM type: YTN; PAM sequence: CTA
tttaggccaggcatggctca

SEQ ID NO: 27248 - DNA, 20 bp, Artificial Sequence
  Description of Artificial Sequence: Synthetic oligonucleotide
  Target: FXN; (-) strand; PAM type: YTN; PAM sequence: TTG
caaacacagagagctattta

SEQ ID NO: 27249 - DNA, 20 bp, Artificial Sequence
  Description of Artificial Sequence: Synthetic oligonucleotide
  Target: FXN; (-) strand; PAM type: YTN; PAM sequence: TTT
gcaaacacagagagctattt

SEQ ID NO: 27250 - DNA, 20 bp, Artificial Sequence
  Description of Artificial Sequence: Synthetic oligonucleotide
  Target: FXN; (-) strand; PAM type: YTN; PAM sequence: TTT
tgcaaacacagagagctatt

SEQ ID NO: 27251 - DNA, 20 bp, Artificial Sequence
  Description of Artificial Sequence: Synthetic oligonucleotide
  Target: FXN; (-) strand; PAM type: YTN; PAM sequence: CTT
ttgcaaacacagagagctat

SEQ ID NO: 27252 - DNA, 20 bp, Artificial Sequence
  Description of Artificial Sequence: Synthetic oligonucleotide
  Target: FXN; (-) strand; PAM type: YTN; PAM sequence: TTA
taacacacttttgcaaacac

SEQ ID NO: 27253 - DNA, 20 bp, Artificial Sequence
  Description of Artificial Sequence: Synthetic oligonucleotide
  Target: FXN; (-) strand; PAM type: YTN; PAM sequence: CTT
ataacacacttttgcaaaca

SEQ ID NO: 27254 - DNA, 20 bp, Artificial Sequence
  Description of Artificial Sequence: Synthetic oligonucleotide
  Target: FXN; (-) strand; PAM type: YTN; PAM sequence: TTC
ttataacacacttttgcaaa

SEQ ID NO: 27255 - DNA, 20 bp, Artificial Sequence
  Description of Artificial Sequence: Synthetic oligonucleotide
  Target: FXN; (-) strand; PAM type: YTN; PAM sequence: CTG
aatgattcttataacacact

SEQ ID NO: 27256 - DNA, 20 bp, Artificial Sequence
  Description of Artificial Sequence: Synthetic oligonucleotide
  Target: FXN; (-) strand; PAM type: YTN; PAM sequence: CTC
tgaatgattcttataacaca

SEQ ID NO: 27257 - DNA, 20 bp, Artificial Sequence
  Description of Artificial Sequence: Synthetic oligonucleotide
  Target: FXN; (-) strand; PAM type: YTN; PAM sequence: CTC
catccaatcgagaggctctg

SEQ ID NO: 27258 - DNA, 20 bp, Artificial Sequence
  Description of Artificial Sequence: Synthetic oligonucleotide
  Target: FXN; (-) strand; PAM type: YTN; PAM sequence: CTA
gagcctccatccaatcgaga

SEQ ID NO: 27259 - DNA, 20 bp, Artificial Sequence
  Description of Artificial Sequence: Synthetic oligonucleotide
  Target: FXN; (-) strand; PAM type: YTN; PAM sequence: TTC
tagagcctccatccaatcga

SEQ ID NO: 27260 - DNA, 20 bp, Artificial Sequence
  Description of Artificial Sequence: Synthetic oligonucleotide
  Target: FXN; (-) strand; PAM type: YTN; PAM sequence: CTG
tgcattctagagcctccatc

SEQ ID NO: 27261 - DNA, 20 bp, Artificial Sequence
  Description of Artificial Sequence: Synthetic oligonucleotide
  Target: FXN; (-) strand; PAM type: YTN; PAM sequence: TTC
tgtgcattctagagcctcca

SEQ ID NO: 27262 - DNA, 20 bp, Artificial Sequence
  Description of Artificial Sequence: Synthetic oligonucleotide
  Target: FXN; (-) strand; PAM type: YTN; PAM sequence: TTT
ctgtgcattctagagcctcc

SEQ ID NO: 27263 - DNA, 20 bp, Artificial Sequence
  Description of Artificial Sequence: Synthetic oligonucleotide
  Target: FXN; (-) strand; PAM type: YTN; PAM sequence: TTT
tctgtgcattctagagcctc

SEQ ID NO: 27264 - DNA, 20 bp, Artificial Sequence
  Description of Artificial Sequence: Synthetic oligonucleotide
  Target: FXN; (-) strand; PAM type: YTN; PAM sequence: TTT
ttctgtgcattctagagcct

SEQ ID NO: 27265 - DNA, 20 bp, Artificial Sequence
  Description of Artificial Sequence: Synthetic oligonucleotide
  Target: FXN; (-) strand; PAM type: YTN; PAM sequence: CTT
tttctgtgcattctagagcc

SEQ ID NO: 27266 - DNA, 20 bp, Artificial Sequence
  Description of Artificial Sequence: Synthetic oligonucleotide
  Target: FXN; (-) strand; PAM type: YTN; PAM sequence: TTG
cagagatacacggtggcagc

SEQ ID NO: 27267 - DNA, 20 bp, Artificial Sequence
  Description of Artificial Sequence: Synthetic oligonucleotide
  Target: FXN; (-) strand; PAM type: YTN; PAM sequence: CTT
gcagagatacacggtggcag

SEQ ID NO: 27268 - DNA, 20 bp, Artificial Sequence
  Description of Artificial Sequence: Synthetic oligonucleotide
  Target: FXN; (-) strand; PAM type: YTN; PAM sequence: TTG
tgcatgacttgcagagatac

SEQ ID NO: 27269 - DNA, 20 bp, Artificial Sequence
  Description of Artificial Sequence: Synthetic oligonucleotide
  Target: FXN; (-) strand; PAM type: YTN; PAM sequence: CTT
gtgcatgacttgcagagata

SEQ ID NO: 27270 - DNA, 20 bp, Artificial Sequence
  Description of Artificial Sequence: Synthetic oligonucleotide
  Target: FXN; (-) strand; PAM type: YTN; PAM sequence: TTC
cccatcttgtgcatgacttg

SEQ ID NO: 27271 - DNA, 20 bp, Artificial Sequence
  Description of Artificial Sequence: Synthetic oligonucleotide
  Target: FXN; (-) strand; PAM type: YTN; PAM sequence: CTG
ttccccatcttgtgcatgac

SEQ ID NO: 27272 - DNA, 20 bp, Artificial Sequence
  Description of Artificial Sequence: Synthetic oligonucleotide
  Target: FXN; (-) strand; PAM type: YTN; PAM sequence: CTG
ctgttccccatcttgtgcat

SEQ ID NO: 27273 - DNA, 20 bp, Artificial Sequence
  Description of Artificial Sequence: Synthetic oligonucleotide
  Target: FXN; (-) strand; PAM type: YTN; PAM sequence: CTG
gtaagcagggggaagcctgc

SEQ ID NO: 27274 - DNA, 20 bp, Artificial Sequence
  Description of Artificial Sequence: Synthetic oligonucleotide
  Target: FXN; (-) strand; PAM type: YTN; PAM sequence: TTG
aactggtaagcagggggaag

SEQ ID NO: 27275 - DNA, 20 bp, Artificial Sequence
  Description of Artificial Sequence: Synthetic oligonucleotide
  Target: FXN; (-) strand; PAM type: YTN; PAM sequence: TTT
gaactggtaagcagggggaa

SEQ ID NO: 27276 - DNA, 20 bp, Artificial Sequence
  Description of Artificial Sequence: Synthetic oligonucleotide
  Target: FXN; (-) strand; PAM type: YTN; PAM sequence: CTG
tatttgaactggtaagcagg

SEQ ID NO: 27277 - DNA, 20 bp, Artificial Sequence
  Description of Artificial Sequence: Synthetic oligonucleotide
  Target: FXN; (-) strand; PAM type: YTN; PAM sequence: CTC
tgtatttgaactggtaagca

SEQ ID NO: 27278 - DNA, 20 bp, Artificial Sequence
  Description of Artificial Sequence: Synthetic oligonucleotide
  Target: FXN; (-) strand; PAM type: YTN; PAM sequence: TTC
tctgtatttgaactggtaag

SEQ ID NO: 27279 - DNA, 20 bp, Artificial Sequence
  Description of Artificial Sequence: Synthetic oligonucleotide
  Target: FXN; (-) strand; PAM type: YTN; PAM sequence: CTA
gttctctgtatttgaactgg

SEQ ID NO: 27280 - DNA, 20 bp, Artificial Sequence
  Description of Artificial Sequence: Synthetic oligonucleotide
  Target: FXN; (-) strand; PAM type: YTN; PAM sequence: CTA
cagggctagttctctgtatt

SEQ ID NO: 27281 - DNA, 20 bp, Artificial Sequence
  Description of Artificial Sequence: Synthetic oligonucleotide
  Target: FXN; (-) strand; PAM type: YTN; PAM sequence: TTA
gaatgggtgagatatgaaag

SEQ ID NO: 27282 - DNA, 20 bp, Artificial Sequence
  Description of Artificial Sequence: Synthetic oligonucleotide
  Target: FXN; (-) strand; PAM type: YTN; PAM sequence: TTT
agaatgggtgagatatgaaa

SEQ ID NO: 27283 - DNA, 20 bp, Artificial Sequence
  Description of Artificial Sequence: Synthetic oligonucleotide
  Target: FXN; (-) strand; PAM type: YTN; PAM sequence: CTT
tagaatgggtgagatatgaa

SEQ ID NO: 27284 - DNA, 20 bp, Artificial Sequence
  Description of Artificial Sequence: Synthetic oligonucleotide
  Target: FXN; (-) strand; PAM type: YTN; PAM sequence: CTC
tttagaatgggtgagatatg

SEQ ID NO: 27285 - DNA, 20 bp, Artificial Sequence
  Description of Artificial Sequence: Synthetic oligonucleotide
  Target: FXN; (-) strand; PAM type: YTN; PAM sequence: CTG
tggtctctttagaatgggtg

SEQ ID NO: 27286 - DNA, 20 bp, Artificial Sequence
  Description of Artificial Sequence: Synthetic oligonucleotide
  Target: FXN; (-) strand; PAM type: YTN; PAM sequence: CTA
aggcctgtggtctctttaga

SEQ ID NO: 27287 - DNA, 20 bp, Artificial Sequence
  Description of Artificial Sequence: Synthetic oligonucleotide
  Target: FXN; (-) strand; PAM type: YTN; PAM sequence: TTC
taaggcctgtggtctcttta

SEQ ID NO: 27288 - DNA, 20 bp, Artificial Sequence
  Description of Artificial Sequence: Synthetic oligonucleotide
  Target: FXN; (-) strand; PAM type: YTN; PAM sequence: CTT
ctaaggcctgtggtctcttt

SEQ ID NO: 27289 - DNA, 20 bp, Artificial Sequence
  Description of Artificial Sequence: Synthetic oligonucleotide
  Target: FXN; (-) strand; PAM type: YTN; PAM sequence: TTA
cttctaaggcctgtggtctc

SEQ ID NO: 27290 - DNA, 20 bp, Artificial Sequence
  Description of Artificial Sequence: Synthetic oligonucleotide
  Target: FXN; (-) strand; PAM type: YTN; PAM sequence: TTT
acttctaaggcctgtggtct

SEQ ID NO: 27291 - DNA, 20 bp, Artificial Sequence
  Description of Artificial Sequence: Synthetic oligonucleotide
  Target: FXN; (-) strand; PAM type: YTN; PAM sequence: CTT
tacttctaaggcctgtggtc

SEQ ID NO: 27292 - DNA, 20 bp, Artificial Sequence
  Description of Artificial Sequence: Synthetic oligonucleotide
  Target: FXN; (-) strand; PAM type: YTN; PAM sequence: TTC
aacaaaagagtcctttactt

SEQ ID NO: 27293 - DNA, 20 bp, Artificial Sequence
  Description of Artificial Sequence: Synthetic oligonucleotide
  Target: FXN; (-) strand; PAM type: YTN; PAM sequence: TTT
caacaaaagagtcctttact

SEQ ID NO: 27294 - DNA, 20 bp, Artificial Sequence
  Description of Artificial Sequence: Synthetic oligonucleotide
  Target: FXN; (-) strand; PAM type: YTN; PAM sequence: CTT
tcaacaaaagagtcctttac

SEQ ID NO: 27295 - DNA, 20 bp, Artificial Sequence
  Description of Artificial Sequence: Synthetic oligonucleotide
  Target: FXN; (-) strand; PAM type: YTN; PAM sequence: CTC
tttcaacaaaagagtccttt

SEQ ID NO: 27296 - DNA, 20 bp, Artificial Sequence
  Description of Artificial Sequence: Synthetic oligonucleotide
  Target: FXN; (-) strand; PAM type: YTN; PAM sequence: TTG
aaaacactctttcaacaaaa

SEQ ID NO: 27297 - DNA, 20 bp, Artificial Sequence
  Description of Artificial Sequence: Synthetic oligonucleotide
  Target: FXN; (-) strand; PAM type: YTN; PAM sequence: TTT
gaaaacactctttcaacaaa

SEQ ID NO: 27298 - DNA, 20 bp, Artificial Sequence
  Description of Artificial Sequence: Synthetic oligonucleotide
  Target: FXN; (-) strand; PAM type: YTN; PAM sequence: TTA
aatttgaaaacactctttca

SEQ ID NO: 27299 - DNA, 20 bp, Artificial Sequence
  Description of Artificial Sequence: Synthetic oligonucleotide
  Target: FXN; (-) strand; PAM type: YTN; PAM sequence: TTT
aaatttgaaaacactctttc

SEQ ID NO: 27300 - DNA, 20 bp, Artificial Sequence
  Description of Artificial Sequence: Synthetic oligonucleotide
  Target: FXN; (-) strand; PAM type: YTN; PAM sequence: CTC
atttaaatttgaaaacactc

SEQ ID NO: 27301 - DNA, 20 bp, Artificial Sequence
  Description of Artificial Sequence: Synthetic oligonucleotide
  Target: FXN; (-) strand; PAM type: YTN; PAM sequence: TTG
accaataaatgctcatttaa

SEQ ID NO: 27302 - DNA, 20 bp, Artificial Sequence
  Description of Artificial Sequence: Synthetic oligonucleotide
  Target: FXN; (-) strand; PAM type: YTN; PAM sequence: TTT
gaccaataaatgctcattta

SEQ ID NO: 27303 - DNA, 20 bp, Artificial Sequence
  Description of Artificial Sequence: Synthetic oligonucleotide
  Target: FXN; (-) strand; PAM type: YTN; PAM sequence: CTT
tgaccaataaatgctcattt

SEQ ID NO: 27304 - DNA, 20 bp, Artificial Sequence
  Description of Artificial Sequence: Synthetic oligonucleotide
  Target: FXN; (-) strand; PAM type: YTN; PAM sequence: TTG
gtgcatctttgaccaataaa

SEQ ID NO: 27305 - DNA, 20 bp, Artificial Sequence
  Description of Artificial Sequence: Synthetic oligonucleotide
  Target: FXN; (-) strand; PAM type: YTN; PAM sequence: CTA
gttggtgcatctttgaccaa

SEQ ID NO: 27306 - DNA, 20 bp, Artificial Sequence
  Description of Artificial Sequence: Synthetic oligonucleotide
  Target: FXN; (-) strand; PAM type: YTN; PAM sequence: TTC
aaaagactagttggtgcatc

SEQ ID NO: 27307 - DNA, 20 bp, Artificial Sequence
  Description of Artificial Sequence: Synthetic oligonucleotide
  Target: FXN; (-) strand; PAM type: YTN; PAM sequence: CTT
caaaagactagttggtgcat

SEQ ID NO: 27308 - DNA, 20 bp, Artificial Sequence
  Description of Artificial Sequence: Synthetic oligonucleotide
  Target: FXN; (-) strand; PAM type: YTN; PAM sequence: TTC
ttcaaaagactagttggtgc

SEQ ID NO: 27309 - DNA, 20 bp, Artificial Sequence
  Description of Artificial Sequence: Synthetic oligonucleotide
  Target: FXN; (-) strand; PAM type: YTN; PAM sequence: TTG
aattcttcaaaagactagtt

SEQ ID NO: 27310 - DNA, 20 bp, Artificial Sequence
  Description of Artificial Sequence: Synthetic oligonucleotide
  Target: FXN; (-) strand; PAM type: YTN; PAM sequence: CTT
gaattcttcaaaagactagt

SEQ ID NO: 27311 - DNA, 20 bp, Artificial Sequence
  Description of Artificial Sequence: Synthetic oligonucleotide
  Target: FXN; (-) strand; PAM type: YTN; PAM sequence: CTA
aagagccttgaattcttcaa

SEQ ID NO: 27312 - DNA, 20 bp, Artificial Sequence
  Description of Artificial Sequence: Synthetic oligonucleotide
  Target: FXN; (-) strand; PAM type: YTN; PAM sequence: CTC
taaagagccttgaattcttc

SEQ ID NO: 27313 - DNA, 20 bp, Artificial Sequence
  Description of Artificial Sequence: Synthetic oligonucleotide
  Target: FXN; (-) strand; PAM type: YTN; PAM sequence: TTC
tctaaagagccttgaattct

SEQ ID NO: 27314 - DNA, 20 bp, Artificial Sequence
  Description of Artificial Sequence: Synthetic oligonucleotide
  Target: FXN; (-) strand; PAM type: YTN; PAM sequence: TTT
ctctaaagagccttgaattc

SEQ ID NO: 27315 - DNA, 20 bp, Artificial Sequence
  Description of Artificial Sequence: Synthetic oligonucleotide
  Target: FXN; (-) strand; PAM type: YTN; PAM sequence: TTT
tctctaaagagccttgaatt

SEQ ID NO: 27316 - DNA, 20 bp, Artificial Sequence
  Description of Artificial Sequence: Synthetic oligonucleotide
  Target: FXN; (-) strand; PAM type: YTN; PAM sequence: TTT
ttctctaaagagccttgaat

SEQ ID NO: 27317 - DNA, 20 bp, Artificial Sequence
  Description of Artificial Sequence: Synthetic oligonucleotide
  Target: FXN; (-) strand; PAM type: YTN; PAM sequence: TTA
tttttctctaaagagccttg

SEQ ID NO: 27318 - DNA, 20 bp, Artificial Sequence
  Description of Artificial Sequence: Synthetic oligonucleotide
  Target: FXN; (-) strand; PAM type: YTN; PAM sequence: TTT
atttttctctaaagagcctt

SEQ ID NO: 27319 - DNA, 20 bp, Artificial Sequence
  Description of Artificial Sequence: Synthetic oligonucleotide
  Target: FXN; (-) strand; PAM type: YTN; PAM sequence: CTT
tatttttctctaaagagcct

SEQ ID NO: 27320 - DNA, 20 bp, Artificial Sequence
  Description of Artificial Sequence: Synthetic oligonucleotide
  Target: FXN; (-) strand; PAM type: YTN; PAM sequence: CTC
caaggctttatttttctcta

SEQ ID NO: 27321 - DNA, 20 bp, Artificial Sequence
  Description of Artificial Sequence: Synthetic oligonucleotide
  Target: FXN; (-) strand; PAM type: YTN; PAM sequence: CTC
ctccaaggctttatttttct

SEQ ID NO: 27322 - DNA, 20 bp, Artificial Sequence
  Description of Artificial Sequence: Synthetic oligonucleotide
  Target: FXN; (-) strand; PAM type: YTN; PAM sequence: CTC
agatactcctccaaggcttt

SEQ ID NO: 27323 - DNA, 20 bp, Artificial Sequence
  Description of Artificial Sequence: Synthetic oligonucleotide
  Target: FXN; (-) strand; PAM type: YTN; PAM sequence: TTC
tcagatactcctccaaggct

SEQ ID NO: 27324 - DNA, 20 bp, Artificial Sequence
  Description of Artificial Sequence: Synthetic oligonucleotide
  Target: FXN; (-) strand; PAM type: YTN; PAM sequence: CTT
ctcagatactcctccaaggc

SEQ ID NO: 27325 - DNA, 20 bp, Artificial Sequence
  Description of Artificial Sequence: Synthetic oligonucleotide
  Target: FXN; (-) strand; PAM type: YTN; PAM sequence: CTA
acaagcttctcagatactcc

SEQ ID NO: 27326 - DNA, 20 bp, Artificial Sequence
  Description of Artificial Sequence: Synthetic oligonucleotide
  Target: FXN; (-) strand; PAM type: YTN; PAM sequence: TTC
ccacgcatctaacaagcttc

SEQ ID NO: 27327 - DNA, 20 bp, Artificial Sequence
  Description of Artificial Sequence: Synthetic oligonucleotide
  Target: FXN; (-) strand; PAM type: YTN; PAM sequence: CTT
cccacgcatctaacaagctt

SEQ ID NO: 27328 - DNA, 20 bp, Artificial Sequence
  Description of Artificial Sequence: Synthetic oligonucleotide
  Target: FXN; (-) strand; PAM type: YTN; PAM sequence: CTC
ttcccacgcatctaacaagc

SEQ ID NO: 27329 - DNA, 20 bp, Artificial Sequence
  Description of Artificial Sequence: Synthetic oligonucleotide
  Target: FXN; (-) strand; PAM type: YTN; PAM sequence: TTC
cagactcttcccacgcatct

SEQ ID NO: 27330 - DNA, 20 bp, Artificial Sequence
  Description of Artificial Sequence: Synthetic oligonucleotide
  Target: FXN; (-) strand; PAM type: YTN; PAM sequence: TTT
ccagactcttcccacgcatc

SEQ ID NO: 27331 - DNA, 20 bp, Artificial Sequence
  Description of Artificial Sequence: Synthetic oligonucleotide
  Target: FXN; (-) strand; PAM type: YTN; PAM sequence: TTA
tttccagactcttcccacgc

SEQ ID NO: 27332 - DNA, 20 bp, Artificial Sequence
  Description of Artificial Sequence: Synthetic oligonucleotide
  Target: FXN; (-) strand; PAM type: YTN; PAM sequence: TTT
atttccagactcttcccacg

SEQ ID NO: 27333 - DNA, 20 bp, Artificial Sequence
  Description of Artificial Sequence: Synthetic oligonucleotide
  Target: FXN; (-) strand; PAM type: YTN; PAM sequence: TTT
tatttccagactcttcccac

SEQ ID NO: 27334 - DNA, 20 bp, Artificial Sequence
  Description of Artificial Sequence: Synthetic oligonucleotide
  Target: FXN; (-) strand; PAM type: YTN; PAM sequence: TTT
ttatttccagactcttccca

SEQ ID NO: 27335 - DNA, 20 bp, Artificial Sequence
  Description of Artificial Sequence: Synthetic oligonucleotide
  Target: FXN; (-) strand; PAM type: YTN; PAM sequence: TTT
tttatttccagactcttccc

SEQ ID NO: 27336 - DNA, 20 bp, Artificial Sequence
  Description of Artificial Sequence: Synthetic oligonucleotide
  Target: FXN; (-) strand; PAM type: YTN; PAM sequence: CTC
cagatgaagttttttatttc

SEQ ID NO: 27337 - DNA, 20 bp, Artificial Sequence
  Description of Artificial Sequence: Synthetic oligonucleotide
  Target: FXN; (-) strand; PAM type: YTN; PAM sequence: TTG
gtagaaggcagaaactccag

SEQ ID NO: 27338 - DNA, 20 bp, Artificial Sequence
  Description of Artificial Sequence: Synthetic oligonucleotide
  Target: FXN; (-) strand; PAM type: YTN; PAM sequence: CTG
ttggtagaaggcagaaactc

SEQ ID NO: 27339 - DNA, 20 bp, Artificial Sequence
  Description of Artificial Sequence: Synthetic oligonucleotide
  Target: FXN; (-) strand; PAM type: YTN; PAM sequence: CTC
tgttggtagaaggcagaaac

SEQ ID NO: 27340 - DNA, 20 bp, Artificial Sequence
  Description of Artificial Sequence: Synthetic oligonucleotide
  Target: FXN; (-) strand; PAM type: YTN; PAM sequence: TTC
agctctgttggtagaaggca

SEQ ID NO: 27341 - DNA, 20 bp, Artificial Sequence
  Description of Artificial Sequence: Synthetic oligonucleotide
  Target: FXN; (-) strand; PAM type: YTN; PAM sequence: CTT
cagctctgttggtagaaggc

SEQ ID NO: 27342 - DNA, 20 bp, Artificial Sequence
  Description of Artificial Sequence: Synthetic oligonucleotide
  Target: FXN; (-) strand; PAM type: YTN; PAM sequence: TTA
gcttcagctctgttggtaga

SEQ ID NO: 27343 - DNA, 20 bp, Artificial Sequence
  Description of Artificial Sequence: Synthetic oligonucleotide
  Target: FXN; (-) strand; PAM type: YTN; PAM sequence: TTA
ggagagcattagcttcagct

SEQ ID NO: 27344 - DNA, 20 bp, Artificial Sequence
  Description of Artificial Sequence: Synthetic oligonucleotide
  Target: FXN; (-) strand; PAM type: YTN; PAM sequence: CTT
aggagagcattagcttcagc

SEQ ID NO: 27345 - DNA, 20 bp, Artificial Sequence
  Description of Artificial Sequence: Synthetic oligonucleotide
  Target: FXN; (-) strand; PAM type: YTN; PAM sequence: TTG
tcttaggagagcattagctt

SEQ ID NO: 27346 - DNA, 20 bp, Artificial Sequence
  Description of Artificial Sequence: Synthetic oligonucleotide
  Target: FXN; (-) strand; PAM type: YTN; PAM sequence: CTT
gtcttaggagagcattagct

SEQ ID NO: 27347 - DNA, 20 bp, Artificial Sequence
  Description of Artificial Sequence: Synthetic oligonucleotide
  Target: FXN; (-) strand; PAM type: YTN; PAM sequence: TTG
cttgtcttaggagagcatta

SEQ ID NO: 27348 - DNA, 20 bp, Artificial Sequence
  Description of Artificial Sequence: Synthetic oligonucleotide
  Target: FXN; (-) strand; PAM type: YTN; PAM sequence: TTT
gcttgtcttaggagagcatt

SEQ ID NO: 27349 - DNA, 20 bp, Artificial Sequence
  Description of Artificial Sequence: Synthetic oligonucleotide
  Target: FXN; (-) strand; PAM type: YTN; PAM sequence: CTT
tgcttgtcttaggagagcat

SEQ ID NO: 27350 - DNA, 20 bp, Artificial Sequence
  Description of Artificial Sequence: Synthetic oligonucleotide
  Target: FXN; (-) strand; PAM type: YTN; PAM sequence: CTG
ctttgcttgtcttaggagag

SEQ ID NO: 27351 - DNA, 20 bp, Artificial Sequence
  Description of Artificial Sequence: Synthetic oligonucleotide
  Target: FXN; (-) strand; PAM type: YTN; PAM sequence: TTA
cagaggaagtaaaaggaagg

SEQ ID NO: 27352 - DNA, 20 bp, Artificial Sequence
  Description of Artificial Sequence: Synthetic oligonucleotide
  Target: FXN; (-) strand; PAM type: YTN; PAM sequence: CTA
ttacagaggaagtaaaagga

SEQ ID NO: 27353 - DNA, 20 bp, Artificial Sequence
  Description of Artificial Sequence: Synthetic oligonucleotide
  Target: FXN; (-) strand; PAM type: YTN; PAM sequence: CTC
aaacatcagacatgacaagt

SEQ ID NO: 27354 - DNA, 20 bp, Artificial Sequence
  Description of Artificial Sequence: Synthetic oligonucleotide
  Target: FXN; (-) strand; PAM type: YTN; PAM sequence: TTA
gagtaccacgtcaactcaaa

SEQ ID NO: 27355 - DNA, 20 bp, Artificial Sequence
  Description of Artificial Sequence: Synthetic oligonucleotide
  Target: FXN; (-) strand; PAM type: YTN; PAM sequence: CTA
ttagagtaccacgtcaactc

SEQ ID NO: 27356 - DNA, 20 bp, Artificial Sequence
  Description of Artificial Sequence: Synthetic oligonucleotide
  Target: FXN; (-) strand; PAM type: YTN; PAM sequence: CTC
tattagagtaccacgtcaac

SEQ ID NO: 27357 - DNA, 20 bp, Artificial Sequence
  Description of Artificial Sequence: Synthetic oligonucleotide
  Target: FXN; (-) strand; PAM type: YTN; PAM sequence: CTA
actctattagagtaccacgt

SEQ ID NO: 27358 - DNA, 20 bp, Artificial Sequence
  Description of Artificial Sequence: Synthetic oligonucleotide
  Target: FXN; (-) strand; PAM type: YTN; PAM sequence: CTC
taactctattagagtaccac

SEQ ID NO: 27359 - DNA, 20 bp, Artificial Sequence
  Description of Artificial Sequence: Synthetic oligonucleotide
  Target: FXN; (-) strand; PAM type: YTN; PAM sequence: CTA
gaggacataaaaaaaatgca

SEQ ID NO: 27360 - DNA, 20 bp, Artificial Sequence
  Description of Artificial Sequence: Synthetic oligonucleotide
  Target: FXN; (-) strand; PAM type: YTN; PAM sequence: CTC
aaccatcaaccagaacatac

SEQ ID NO: 27361 - DNA, 20 bp, Artificial Sequence
  Description of Artificial Sequence: Synthetic oligonucleotide
  Target: FXN; (-) strand; PAM type: YTN; PAM sequence: TTG
ccctcaaccatcaaccagaa

SEQ ID NO: 27362 - DNA, 20 bp, Artificial Sequence
  Description of Artificial Sequence: Synthetic oligonucleotide
  Target: FXN; (-) strand; PAM type: YTN; PAM sequence: TTG
ttgccctcaaccatcaacca

SEQ ID NO: 27363 - DNA, 20 bp, Artificial Sequence
  Description of Artificial Sequence: Synthetic oligonucleotide
  Target: FXN; (-) strand; PAM type: YTN; PAM sequence: TTT
gttgccctcaaccatcaacc

SEQ ID NO: 27364 - DNA, 20 bp, Artificial Sequence
  Description of Artificial Sequence: Synthetic oligonucleotide
  Target: FXN; (-) strand; PAM type: YTN; PAM sequence: CTG
gtttgttgccctcaaccatc

SEQ ID NO: 27365 - DNA, 20 bp, Artificial Sequence
  Description of Artificial Sequence: Synthetic oligonucleotide
  Target: FXN; (-) strand; PAM type: YTN; PAM sequence: CTG
ctggtttgttgccctcaacc

SEQ ID NO: 27366 - DNA, 20 bp, Artificial Sequence
  Description of Artificial Sequence: Synthetic oligonucleotide
  Target: FXN; (-) strand; PAM type: YTN; PAM sequence: CTG
ggactgctggtttgttgccc

SEQ ID NO: 27367 - DNA, 20 bp, Artificial Sequence
  Description of Artificial Sequence: Synthetic oligonucleotide
  Target: FXN; (-) strand; PAM type: YTN; PAM sequence: CTG
gcatctgggactgctggttt

SEQ ID NO: 27368 - DNA, 20 bp, Artificial Sequence
  Description of Artificial Sequence: Synthetic oligonucleotide
  Target: FXN; (-) strand; PAM type: YTN; PAM sequence: TTG
gtgctggcatctgggactgc

SEQ ID NO: 27369 - DNA, 20 bp, Artificial Sequence
  Description of Artificial Sequence: Synthetic oligonucleotide
  Target: FXN; (-) strand; PAM type: YTN; PAM sequence: CTT
ggtgctggcatctgggactg

SEQ ID NO: 27370 - DNA, 20 bp, Artificial Sequence
  Description of Artificial Sequence: Synthetic oligonucleotide
  Target: FXN; (-) strand; PAM type: YTN; PAM sequence: CTC
aggtcttggtgctggcatct

SEQ ID NO: 27371 - DNA, 20 bp, Artificial Sequence
  Description of Artificial Sequence: Synthetic oligonucleotide
  Target: FXN; (-) strand; PAM type: YTN; PAM sequence: CTG
tctcaggtcttggtgctggc

SEQ ID NO: 27372 - DNA, 20 bp, Artificial Sequence
  Description of Artificial Sequence: Synthetic oligonucleotide
  Target: FXN; (-) strand; PAM type: YTN; PAM sequence: TTA
agtgacctgtctcaggtctt

SEQ ID NO: 27373 - DNA, 20 bp, Artificial Sequence
  Description of Artificial Sequence: Synthetic oligonucleotide
  Target: FXN; (-) strand; PAM type: YTN; PAM sequence: CTC
ggagagttaagtgacctgtc

SEQ ID NO: 27374 - DNA, 20 bp, Artificial Sequence
  Description of Artificial Sequence: Synthetic oligonucleotide
  Target: FXN; (-) strand; PAM type: YTN; PAM sequence: CTG
caaggtgagaatggtggtga

SEQ ID NO: 27375 - DNA, 20 bp, Artificial Sequence
  Description of Artificial Sequence: Synthetic oligonucleotide
  Target: FXN; (-) strand; PAM type: YTN; PAM sequence: CTG
tgaggtctgcaaggtgagaa

SEQ ID NO: 27376 - DNA, 20 bp, Artificial Sequence
  Description of Artificial Sequence: Synthetic oligonucleotide
  Target: FXN; (-) strand; PAM type: YTN; PAM sequence: TTC
cctgtgaggtctgcaaggtg

SEQ ID NO: 27377 - DNA, 20 bp, Artificial Sequence
  Description of Artificial Sequence: Synthetic oligonucleotide
  Target: FXN; (-) strand; PAM type: YTN; PAM sequence: CTG
ttccctgtgaggtctgcaag

SEQ ID NO: 27378 - DNA, 20 bp, Artificial Sequence
  Description of Artificial Sequence: Synthetic oligonucleotide
  Target: FXN; (-) strand; PAM type: YTN; PAM sequence: TTC
cctgttccctgtgaggtctg

SEQ ID NO: 27379 - DNA, 20 bp, Artificial Sequence
  Description of Artificial Sequence: Synthetic oligonucleotide
  Target: FXN; (-) strand; PAM type: YTN; PAM sequence: TTT
ccctgttccctgtgaggtct

SEQ ID NO: 27380 - DNA, 20 bp, Artificial Sequence
  Description of Artificial Sequence: Synthetic oligonucleotide
  Target: FXN; (-) strand; PAM type: YTN; PAM sequence: CTT
tccctgttccctgtgaggtc

SEQ ID NO: 27381 - DNA, 20 bp, Artificial Sequence
  Description of Artificial Sequence: Synthetic oligonucleotide
  Target: FXN; (-) strand; PAM type: YTN; PAM sequence: CTC
atagagctttccctgttccc

SEQ ID NO: 27382 - DNA, 20 bp, Artificial Sequence
  Description of Artificial Sequence: Synthetic oligonucleotide
  Target: FXN; (-) strand; PAM type: YTN; PAM sequence: TTG
tatctcatagagctttccct

SEQ ID NO: 27383 - DNA, 20 bp, Artificial Sequence
  Description of Artificial Sequence: Synthetic oligonucleotide
  Target: FXN; (-) strand; PAM type: YTN; PAM sequence: TTA
atcataatgatgttgtatct

SEQ ID NO: 27384 - DNA, 20 bp, Artificial Sequence
  Description of Artificial Sequence: Synthetic oligonucleotide
  Target: FXN; (-) strand; PAM type: YTN; PAM sequence: TTC
agaatcagaataggattaat

SEQ ID NO: 27385 - DNA, 20 bp, Artificial Sequence
  Description of Artificial Sequence: Synthetic oligonucleotide
  Target: FXN; (-) strand; PAM type: YTN; PAM sequence: TTT
cagaatcagaataggattaa

SEQ ID NO: 27386 - DNA, 20 bp, Artificial Sequence
  Description of Artificial Sequence: Synthetic oligonucleotide
  Target: FXN; (-) strand; PAM type: YTN; PAM sequence: CTT
tcagaatcagaataggatta

SEQ ID NO: 27387 - DNA, 20 bp, Artificial Sequence
  Description of Artificial Sequence: Synthetic oligonucleotide
  Target: FXN; (-) strand; PAM type: YTN; PAM sequence: TTG
ctttcagaatcagaatagga

SEQ ID NO: 27388 - DNA, 20 bp, Artificial Sequence
  Description of Artificial Sequence: Synthetic oligonucleotide
  Target: FXN; (-) strand; PAM type: YTN; PAM sequence: TTT
gctttcagaatcagaatagg

SEQ ID NO: 27389 - DNA, 20 bp, Artificial Sequence
  Description of Artificial Sequence: Synthetic oligonucleotide
  Target: FXN; (-) strand; PAM type: YTN; PAM sequence: CTT
tgctttcagaatcagaatag

SEQ ID NO: 27390 - DNA, 20 bp, Artificial Sequence
  Description of Artificial Sequence: Synthetic oligonucleotide
  Target: FXN; (-) strand; PAM type: YTN; PAM sequence: TTG
tgtaggaagagctttgcttt

SEQ ID NO: 27391 - DNA, 20 bp, Artificial Sequence
  Description of Artificial Sequence: Synthetic oligonucleotide
  Target: FXN; (-) strand; PAM type: YTN; PAM sequence: TTT
gtgtaggaagagctttgctt

SEQ ID NO: 27392 - DNA, 20 bp, Artificial Sequence
  Description of Artificial Sequence: Synthetic oligonucleotide
  Target: FXN; (-) strand; PAM type: YTN; PAM sequence: TTA
gaaataggagtttgtgtagg

SEQ ID NO: 27393 - DNA, 20 bp, Artificial Sequence
  Description of Artificial Sequence: Synthetic oligonucleotide
  Target: FXN; (-) strand; PAM type: YTN; PAM sequence: TTT
agaaataggagtttgtgtag

SEQ ID NO: 27394 - DNA, 20 bp, Artificial Sequence
  Description of Artificial Sequence: Synthetic oligonucleotide
  Target: FXN; (-) strand; PAM type: YTN; PAM sequence: TTA
gtatttagaaataggagttt

SEQ ID NO: 27395 - DNA, 20 bp, Artificial Sequence
  Description of Artificial Sequence: Synthetic oligonucleotide
  Target: FXN; (-) strand; PAM type: YTN; PAM sequence: TTT
agtatttagaaataggagtt

SEQ ID NO: 27396 - DNA, 20 bp, Artificial Sequence
  Description of Artificial Sequence: Synthetic oligonucleotide
  Target: FXN; (-) strand; PAM type: YTN; PAM sequence: TTT
tagtatttagaaataggagt

SEQ ID NO: 27397 - DNA, 20 bp, Artificial Sequence
  Description of Artificial Sequence: Synthetic oligonucleotide
  Target: FXN; (-) strand; PAM type: YTN; PAM sequence: CTT
ttagtatttagaaataggag

SEQ ID NO: 27398 - DNA, 20 bp, Artificial Sequence
  Description of Artificial Sequence: Synthetic oligonucleotide
  Target: FXN; (-) strand; PAM type: YTN; PAM sequence: CTA
caagtacacaaaatacacca

SEQ ID NO: 27399 - DNA, 20 bp, Artificial Sequence
  Description of Artificial Sequence: Synthetic oligonucleotide
  Target: FXN; (-) strand; PAM type: YTN; PAM sequence: TTC
tacaagtacacaaaatacac

SEQ ID NO: 27400 - DNA, 20 bp, Artificial Sequence
  Description of Artificial Sequence: Synthetic oligonucleotide
  Target: FXN; (-) strand; PAM type: YTN; PAM sequence: TTT
ctacaagtacacaaaataca

SEQ ID NO: 27401 - DNA, 20 bp, Artificial Sequence
  Description of Artificial Sequence: Synthetic oligonucleotide
  Target: FXN; (-) strand; PAM type: YTN; PAM sequence: TTC
catttctacaagtacacaaa

SEQ ID NO: 27402 - DNA, 20 bp, Artificial Sequence
  Description of Artificial Sequence: Synthetic oligonucleotide
  Target: FXN; (-) strand; PAM type: YTN; PAM sequence: TTT
ccatttctacaagtacacaa

SEQ ID NO: 27403 - DNA, 20 bp, Artificial Sequence
  Description of Artificial Sequence: Synthetic oligonucleotide
  Target: FXN; (-) strand; PAM type: YTN; PAM sequence: CTT
tccatttctacaagtacaca

SEQ ID NO: 27404 - DNA, 20 bp, Artificial Sequence
  Description of Artificial Sequence: Synthetic oligonucleotide
  Target: FXN; (-) strand; PAM type: YTN; PAM sequence: CTC
aacactttccatttctacaa

SEQ ID NO: 27405 - DNA, 20 bp, Artificial Sequence
  Description of Artificial Sequence: Synthetic oligonucleotide
  Target: FXN; (-) strand; PAM type: YTN; PAM sequence: TTA
tctcaacactttccatttct

SEQ ID NO: 27406 - DNA, 20 bp, Artificial Sequence
  Description of Artificial Sequence: Synthetic oligonucleotide
  Target: FXN; (-) strand; PAM type: YTN; PAM sequence: TTT
atctcaacactttccatttc

SEQ ID NO: 27407 - DNA, 20 bp, Artificial Sequence
  Description of Artificial Sequence: Synthetic oligonucleotide
  Target: FXN; (-) strand; PAM type: YTN; PAM sequence: TTT
tatctcaacactttccattt

SEQ ID NO: 27408 - DNA, 20 bp, Artificial Sequence
  Description of Artificial Sequence: Synthetic oligonucleotide
  Target: FXN; (-) strand; PAM type: YTN; PAM sequence: TTC
atgttttatctcaacacttt

SEQ ID NO: 27409 - DNA, 20 bp, Artificial Sequence
  Description of Artificial Sequence: Synthetic oligonucleotide
  Target: FXN; (-) strand; PAM type: YTN; PAM sequence: CTT
catgttttatctcaacactt

SEQ ID NO: 27410 - DNA, 20 bp, Artificial Sequence
  Description of Artificial Sequence: Synthetic oligonucleotide
  Target: FXN; (-) strand; PAM type: YTN; PAM sequence: TTG
cttcatgttttatctcaaca

SEQ ID NO: 27411 - DNA, 20 bp, Artificial Sequence
  Description of Artificial Sequence: Synthetic oligonucleotide
  Target: FXN; (-) strand; PAM type: YTN; PAM sequence: TTG
tcatcattgcttcatgtttt

SEQ ID NO: 27412 - DNA, 20 bp, Artificial Sequence
  Description of Artificial Sequence: Synthetic oligonucleotide
  Target: FXN; (-) strand; PAM type: YTN; PAM sequence: TTT
gtcatcattgcttcatgttt

SEQ ID NO: 27413 - DNA, 20 bp, Artificial Sequence
  Description of Artificial Sequence: Synthetic oligonucleotide
  Target: FXN; (-) strand; PAM type: YTN; PAM sequence: CTT
tgtcatcattgcttcatgtt

SEQ ID NO: 27414 - DNA, 20 bp, Artificial Sequence
  Description of Artificial Sequence: Synthetic oligonucleotide
  Target: FXN; (-) strand; PAM type: YTN; PAM sequence: TTA
gcactttgtcatcattgctt

SEQ ID NO: 27415 - DNA, 20 bp, Artificial Sequence
  Description of Artificial Sequence: Synthetic oligonucleotide
  Target: FXN; (-) strand; PAM type: YTN; PAM sequence: TTA
aaacaagaaaaagttagcac

SEQ ID NO: 27416 - DNA, 20 bp, Artificial Sequence
  Description of Artificial Sequence: Synthetic oligonucleotide
  Target: FXN; (-) strand; PAM type: YTN; PAM sequence: TTA
ggtggaaaaaaagcataaag

SEQ ID NO: 27417 - DNA, 20 bp, Artificial Sequence
  Description of Artificial Sequence: Synthetic oligonucleotide
  Target: FXN; (-) strand; PAM type: YTN; PAM sequence: CTA
ggggattaggtggaaaaaaa

SEQ ID NO: 27418 - DNA, 20 bp, Artificial Sequence
  Description of Artificial Sequence: Synthetic oligonucleotide
  Target: FXN; (-) strand; PAM type: YTN; PAM sequence: CTC
taggggattaggtggaaaaa

SEQ ID NO: 27419 - DNA, 20 bp, Artificial Sequence
  Description of Artificial Sequence: Synthetic oligonucleotide
  Target: FXN; (-) strand; PAM type: YTN; PAM sequence: TTA
agacaccactctaggggatt

SEQ ID NO: 27420 - DNA, 20 bp, Artificial Sequence
  Description of Artificial Sequence: Synthetic oligonucleotide
  Target: FXN; (-) strand; PAM type: YTN; PAM sequence: TTG
acagttaagacaccactcta

SEQ ID NO: 27421 - DNA, 20 bp, Artificial Sequence
  Description of Artificial Sequence: Synthetic oligonucleotide
  Target: FXN; (-) strand; PAM type: YTN; PAM sequence: TTT
gacagttaagacaccactct

SEQ ID NO: 27422 - DNA, 20 bp, Artificial Sequence
  Description of Artificial Sequence: Synthetic oligonucleotide
  Target: FXN; (-) strand; PAM type: YTN; PAM sequence: CTC
cacccagtttgacagttaag

SEQ ID NO: 27423 - DNA, 20 bp, Artificial Sequence
  Description of Artificial Sequence: Synthetic oligonucleotide
  Target: FXN; (-) strand; PAM type: YTN; PAM sequence: CTA
gatctccacccagtttgaca

SEQ ID NO: 27424 - DNA, 20 bp, Artificial Sequence
  Description of Artificial Sequence: Synthetic oligonucleotide
  Target: FXN; (-) strand; PAM type: YTN; PAM sequence: TTC
ctagatctccacccagtttg

SEQ ID NO: 27425 - DNA, 20 bp, Artificial Sequence
  Description of Artificial Sequence: Synthetic oligonucleotide
  Target: FXN; (-) strand; PAM type: YTN; PAM sequence: TTG
atcacataggttcctagatc

SEQ ID NO: 27426 - DNA, 20 bp, Artificial Sequence
  Description of Artificial Sequence: Synthetic oligonucleotide
  Target: FXN; (-) strand; PAM type: YTN; PAM sequence: TTG
ttgatcacataggttcctag

SEQ ID NO: 27427 - DNA, 20 bp, Artificial Sequence
  Description of Artificial Sequence: Synthetic oligonucleotide
  Target: FXN; (-) strand; PAM type: YTN; PAM sequence: CTT
gttgatcacataggttccta

SEQ ID NO: 27428 - DNA, 20 bp, Artificial Sequence
  Description of Artificial Sequence: Synthetic oligonucleotide
  Target: FXN; (-) strand; PAM type: YTN; PAM sequence: CTG
cttgttgatcacataggttc

SEQ ID NO: 27429 - DNA, 20 bp, Artificial Sequence
  Description of Artificial Sequence: Synthetic oligonucleotide
  Target: FXN; (-) strand; PAM type: YTN; PAM sequence: TTG
gcgtctgcttgttgatcaca

SEQ ID NO: 27430 - DNA, 20 bp, Artificial Sequence
  Description of Artificial Sequence: Synthetic oligonucleotide
  Target: FXN; (-) strand; PAM type: YTN; PAM sequence: TTT
ggcgtctgcttgttgatcac

SEQ ID NO: 27431 - DNA, 20 bp, Artificial Sequence
  Description of Artificial Sequence: Synthetic oligonucleotide
  Target: FXN; (-) strand; PAM type: YTN; PAM sequence: TTG
tttggcgtctgcttgttgat

SEQ ID NO: 27432 - DNA, 20 bp, Artificial Sequence
  Description of Artificial Sequence: Synthetic oligonucleotide
  Target: FXN; (-) strand; PAM type: YTN; PAM sequence: CTT
gtttggcgtctgcttgttga

SEQ ID NO: 27433 - DNA, 20 bp, Artificial Sequence
  Description of Artificial Sequence: Synthetic oligonucleotide
  Target: FXN; (-) strand; PAM type: YTN; PAM sequence: TTG
cttgtttggcgtctgcttgt

SEQ ID NO: 27434 - DNA, 20 bp, Artificial Sequence
  Description of Artificial Sequence: Synthetic oligonucleotide
  Target: FXN; (-) strand; PAM type: YTN; PAM sequence: TTT
gcttgtttggcgtctgcttg

SEQ ID NO: 27435 - DNA, 20 bp, Artificial Sequence
  Description of Artificial Sequence: Synthetic oligonucleotide
  Target: FXN; (-) strand; PAM type: YTN; PAM sequence: CTG
gatggagaagatagccagat

SEQ ID NO: 27436 - DNA, 20 bp, Artificial Sequence
  Description of Artificial Sequence: Synthetic oligonucleotide
  Target: FXN; (-) strand; PAM type: YTN; PAM sequence: CTA
catacctggatggagaagat

SEQ ID NO: 27437 - DNA, 20 bp, Artificial Sequence
  Description of Artificial Sequence: Synthetic oligonucleotide
  Target: FXN; (-) strand; PAM type: YTN; PAM sequence: CTG
aacatacctacatacctgga

SEQ ID NO: 27438 - DNA, 20 bp, Artificial Sequence
  Description of Artificial Sequence: Synthetic oligonucleotide
  Target: FXN; (-) strand; PAM type: YTN; PAM sequence: TTC
tgaacatacctacatacctg

SEQ ID NO: 27439 - DNA, 20 bp, Artificial Sequence
  Description of Artificial Sequence: Synthetic oligonucleotide
  Target: FXN; (-) strand; PAM type: YTN; PAM sequence: CTT
ctgaacatacctacatacct

SEQ ID NO: 27440 - DNA, 20 bp, Artificial Sequence
  Description of Artificial Sequence: Synthetic oligonucleotide
  Target: FXN; (-) strand; PAM type: YTN; PAM sequence: TTG
acttctgaacatacctacat

SEQ ID NO: 27441 - DNA, 20 bp, Artificial Sequence
  Description of Artificial Sequence: Synthetic oligonucleotide
  Target: FXN; (-) strand; PAM type: YTN; PAM sequence: TTA
catatgttgacttctgaaca

SEQ ID NO: 27442 - DNA, 20 bp, Artificial Sequence
  Description of Artificial Sequence: Synthetic oligonucleotide
  Target: FXN; (-) strand; PAM type: YTN; PAM sequence: TTA
agaattacatatgttgactt

SEQ ID NO: 27443 - DNA, 20 bp, Artificial Sequence
  Description of Artificial Sequence: Synthetic oligonucleotide
  Target: FXN; (-) strand; PAM type: YTN; PAM sequence: TTT
aagaattacatatgttgact

SEQ ID NO: 27444 - DNA, 20 bp, Artificial Sequence
  Description of Artificial Sequence: Synthetic oligonucleotide
  Target: FXN; (-) strand; PAM type: YTN; PAM sequence: CTT
taagaattacatatgttgac

SEQ ID NO: 27445 - DNA, 20 bp, Artificial Sequence
  Description of Artificial Sequence: Synthetic oligonucleotide
  Target: FXN; (-) strand; PAM type: YTN; PAM sequence: TTC
ggaagtctttaagaattaca

SEQ ID NO: 27446 - DNA, 20 bp, Artificial Sequence
  Description of Artificial Sequence: Synthetic oligonucleotide
  Target: FXN; (-) strand; PAM type: YTN; PAM sequence: TTT
cggaagtctttaagaattac

SEQ ID NO: 27447 - DNA, 20 bp, Artificial Sequence
  Description of Artificial Sequence: Synthetic oligonucleotide
  Target: FXN; (-) strand; PAM type: YTN; PAM sequence: TTA
aatggtccacaatgtcacat

SEQ ID NO: 27448 - DNA, 20 bp, Artificial Sequence
  Description of Artificial Sequence: Synthetic oligonucleotide
  Target: FXN; (-) strand; PAM type: YTN; PAM sequence: CTT
aaatggtccacaatgtcaca

SEQ ID NO: 27449 - DNA, 20 bp, Artificial Sequence
  Description of Artificial Sequence: Synthetic oligonucleotide
  Target: FXN; (-) strand; PAM type: YTN; PAM sequence: TTC
ttaaatggtccacaatgtca

SEQ ID NO: 27450 - DNA, 20 bp, Artificial Sequence
  Description of Artificial Sequence: Synthetic oligonucleotide
  Target: FXN; (-) strand; PAM type: YTN; PAM sequence: TTT
cttaaatggtccacaatgtc

SEQ ID NO: 27451 - DNA, 20 bp, Artificial Sequence
  Description of Artificial Sequence: Synthetic oligonucleotide
  Target: FXN; (-) strand; PAM type: YTN; PAM sequence: CTC
agccgacatttcttaaatgg

SEQ ID NO: 27452 - DNA, 20 bp, Artificial Sequence
  Description of Artificial Sequence: Synthetic oligonucleotide
  Target: FXN; (-) strand; PAM type: YTN; PAM sequence: CTG
tgctcagccgacatttctta

SEQ ID NO: 27453 - DNA, 20 bp, Artificial Sequence
  Description of Artificial Sequence: Synthetic oligonucleotide
  Target: FXN; (-) strand; PAM type: YTN; PAM sequence: TTA
caggtgtcagccactgtgct

SEQ ID NO: 27454 - DNA, 20 bp, Artificial Sequence
  Description of Artificial Sequence: Synthetic oligonucleotide
  Target: FXN; (-) strand; PAM type: YTN; PAM sequence: TTG
ggattacaggtgtcagccac

SEQ ID NO: 27455 - DNA, 20 bp, Artificial Sequence
  Description of Artificial Sequence: Synthetic oligonucleotide
  Target: FXN; (-) strand; PAM type: YTN; PAM sequence: CTC
aaagtgttgggattacaggt

SEQ ID NO: 27456 - DNA, 20 bp, Artificial Sequence
  Description of Artificial Sequence: Synthetic oligonucleotide
  Target: FXN; (-) strand; PAM type: YTN; PAM sequence: CTC
tcaaagtgttgggattacag

SEQ ID NO: 27457 - DNA, 20 bp, Artificial Sequence
  Description of Artificial Sequence: Synthetic oligonucleotide
  Target: FXN; (-) strand; PAM type: YTN; PAM sequence: CTC
agcctctcaaagtgttggga

SEQ ID NO: 27458 - DNA, 20 bp, Artificial Sequence
  Description of Artificial Sequence: Synthetic oligonucleotide
  Target: FXN; (-) strand; PAM type: YTN; PAM sequence: CTA
cctcagcctctcaaagtgtt

SEQ ID NO: 27459 - DNA, 20 bp, Artificial Sequence
  Description of Artificial Sequence: Synthetic oligonucleotide
  Target: FXN; (-) strand; PAM type: YTN; PAM sequence: CTC
ctacctcagcctctcaaagt

SEQ ID NO: 27460 - DNA, 20 bp, Artificial Sequence
  Description of Artificial Sequence: Synthetic oligonucleotide
  Target: FXN; (-) strand; PAM type: YTN; PAM sequence: CTC
aagtgatcctcctacctcag

SEQ ID NO: 27461 - DNA, 20 bp, Artificial Sequence
  Description of Artificial Sequence: Synthetic oligonucleotide
  Target: FXN; (-) strand; PAM type: YTN; PAM sequence: CTG
tcctcaagtgatcctcctac

SEQ ID NO: 27462 - DNA, 20 bp, Artificial Sequence
  Description of Artificial Sequence: Synthetic oligonucleotide
  Target: FXN; (-) strand; PAM type: YTN; PAM sequence: CTC
ctgtcctcaagtgatcctcc

SEQ ID NO: 27463 - DNA, 20 bp, Artificial Sequence
  Description of Artificial Sequence: Synthetic oligonucleotide
  Target: FXN; (-) strand; PAM type: YTN; PAM sequence: CTG
aactcctgtcctcaagtgat

SEQ ID NO: 27464 - DNA, 20 bp, Artificial Sequence
  Description of Artificial Sequence: Synthetic oligonucleotide
  Target: FXN; (-) strand; PAM type: YTN; PAM sequence: TTC
tgaactcctgtcctcaagtg

SEQ ID NO: 27465 - DNA, 20 bp, Artificial Sequence
  Description of Artificial Sequence: Synthetic oligonucleotide
  Target: FXN; (-) strand; PAM type: YTN; PAM sequence: TTG
cccaggatggttctgaactc

SEQ ID NO: 27466 - DNA, 20 bp, Artificial Sequence
  Description of Artificial Sequence: Synthetic oligonucleotide
  Target: FXN; (-) strand; PAM type: YTN; PAM sequence: CTA
tgttgcccaggatggttctg

SEQ ID NO: 27467 - DNA, 20 bp, Artificial Sequence
  Description of Artificial Sequence: Synthetic oligonucleotide
  Target: FXN; (-) strand; PAM type: YTN; PAM sequence: CTC
actatgttgcccaggatggt

SEQ ID NO: 27468 - DNA, 20 bp, Artificial Sequence
  Description of Artificial Sequence: Synthetic oligonucleotide
  Target: FXN; (-) strand; PAM type: YTN; PAM sequence: TTA
cagagacagggactcactat

SEQ ID NO: 27469 - DNA, 20 bp, Artificial Sequence
  Description of Artificial Sequence: Synthetic oligonucleotide
  Target: FXN; (-) strand; PAM type: YTN; PAM sequence: TTT
acagagacagggactcacta

SEQ ID NO: 27470 - DNA, 20 bp, Artificial Sequence
  Description of Artificial Sequence: Synthetic oligonucleotide
  Target: FXN; (-) strand; PAM type: YTN; PAM sequence: CTT
tacagagacagggactcact

SEQ ID NO: 27471 - DNA, 20 bp, Artificial Sequence
  Description of Artificial Sequence: Synthetic oligonucleotide
  Target: FXN; (-) strand; PAM type: YTN; PAM sequence: TTC
tttacagagacagggactca

SEQ ID NO: 27472 - DNA, 20 bp, Artificial Sequence
  Description of Artificial Sequence: Synthetic oligonucleotide
  Target: FXN; (-) strand; PAM type: YTN; PAM sequence: TTT
ctttacagagacagggactc

SEQ ID NO: 27473 - DNA, 20 bp, Artificial Sequence
  Description of Artificial Sequence: Synthetic oligonucleotide
  Target: FXN; (-) strand; PAM type: YTN; PAM sequence: TTT
tctttacagagacagggact

SEQ ID NO: 27474 - DNA, 20 bp, Artificial Sequence
  Description of Artificial Sequence: Synthetic oligonucleotide
  Target: FXN; (-) strand; PAM type: YTN; PAM sequence: TTA
ttttctttacagagacaggg

SEQ ID NO: 27475 - DNA, 20 bp, Artificial Sequence
  Description of Artificial Sequence: Synthetic oligonucleotide
  Target: FXN; (-) strand; PAM type: YTN; PAM sequence: TTT
attttctttacagagacagg

SEQ ID NO: 27476 - DNA, 20 bp, Artificial Sequence
  Description of Artificial Sequence: Synthetic oligonucleotide
  Target: FXN; (-) strand; PAM type: YTN; PAM sequence: TTT
tattttctttacagagacag

SEQ ID NO: 27477 - DNA, 20 bp, Artificial Sequence
  Description of Artificial Sequence: Synthetic oligonucleotide
  Target: FXN; (-) strand; PAM type: YTN; PAM sequence: TTT
ttattttctttacagagaca

SEQ ID NO: 27478 - DNA, 20 bp, Artificial Sequence
  Description of Artificial Sequence: Synthetic oligonucleotide
  Target: FXN; (-) strand; PAM type: YTN; PAM sequence: TTA
tttttattttctttacagag

SEQ ID NO: 27479 - DNA, 20 bp, Artificial Sequence
  Description of Artificial Sequence: Synthetic oligonucleotide
  Target: FXN; (-) strand; PAM type: YTN; PAM sequence: TTT
atttttattttctttacaga

SEQ ID NO: 27480 - DNA, 20 bp, Artificial Sequence
  Description of Artificial Sequence: Synthetic oligonucleotide
  Target: FXN; (-) strand; PAM type: YTN; PAM sequence: CTT
tatttttattttctttacag

SEQ ID NO: 27481 - DNA, 20 bp, Artificial Sequence
  Description of Artificial Sequence: Synthetic oligonucleotide
  Target: FXN; (-) strand; PAM type: YTN; PAM sequence: CTG
tgactttatttttattttct

SEQ ID NO: 27482 - DNA, 20 bp, Artificial Sequence
  Description of Artificial Sequence: Synthetic oligonucleotide
  Target: FXN; (-) strand; PAM type: YTN; PAM sequence: CTG
cacccagctgtgactttatt

SEQ ID NO: 27483 - DNA, 20 bp, Artificial Sequence
  Description of Artificial Sequence: Synthetic oligonucleotide
  Target: FXN; (-) strand; PAM type: YTN; PAM sequence: TTA
caggtgtaagcctgcaccca

SEQ ID NO: 27484 - DNA, 20 bp, Artificial Sequence
  Description of Artificial Sequence: Synthetic oligonucleotide
  Target: FXN; (-) strand; PAM type: YTN; PAM sequence: CTG
ggattacaggtgtaagcctg

SEQ ID NO: 27485 - DNA, 20 bp, Artificial Sequence
  Description of Artificial Sequence: Synthetic oligonucleotide
  Target: FXN; (-) strand; PAM type: YTN; PAM sequence: CTC
ccaaagtgctgggattacag

SEQ ID NO: 27486 - DNA, 20 bp, Artificial Sequence
  Description of Artificial Sequence: Synthetic oligonucleotide
  Target: FXN; (-) strand; PAM type: YTN; PAM sequence: TTG
gcctcccaaagtgctgggat

SEQ ID NO: 27487 - DNA, 20 bp, Artificial Sequence
  Description of Artificial Sequence: Synthetic oligonucleotide
  Target: FXN; (-) strand; PAM type: YTN; PAM sequence: CTT
ggcctcccaaagtgctggga

SEQ ID NO: 27488 - DNA, 20 bp, Artificial Sequence
  Description of Artificial Sequence: Synthetic oligonucleotide
  Target: FXN; (-) strand; PAM type: YTN; PAM sequence: CTC
aagtgatccacaggccttgg

SEQ ID NO: 27489 - DNA, 20 bp, Artificial Sequence
  Description of Artificial Sequence: Synthetic oligonucleotide
  Target: FXN; (-) strand; PAM type: YTN; PAM sequence: CTG
agctcaagtgatccacaggc

SEQ ID NO: 27490 - DNA, 20 bp, Artificial Sequence
  Description of Artificial Sequence: Synthetic oligonucleotide
  Target: FXN; (-) strand; PAM type: YTN; PAM sequence: CTC
ctgagctcaagtgatccaca

SEQ ID NO: 27491 - DNA, 20 bp, Artificial Sequence
  Description of Artificial Sequence: Synthetic oligonucleotide
  Target: FXN; (-) strand; PAM type: YTN; PAM sequence: CTC
aaactcctgagctcaagtga

SEQ ID NO: 27492 - DNA, 20 bp, Artificial Sequence
  Description of Artificial Sequence: Synthetic oligonucleotide
  Target: FXN; (-) strand; PAM type: YTN; PAM sequence: CTG
gtctcaaactcctgagctca

SEQ ID NO: 27493 - DNA, 20 bp, Artificial Sequence
  Description of Artificial Sequence: Synthetic oligonucleotide
  Target: FXN; (-) strand; PAM type: YTN; PAM sequence: TTG
cccaggctggtctcaaactc

SEQ ID NO: 27494 - DNA, 20 bp, Artificial Sequence
  Description of Artificial Sequence: Synthetic oligonucleotide
  Target: FXN; (-) strand; PAM type: YTN; PAM sequence: TTG
tgacattgcccaggctggtc

SEQ ID NO: 27495 - DNA, 20 bp, Artificial Sequence
  Description of Artificial Sequence: Synthetic oligonucleotide
  Target: FXN; (-) strand; PAM type: YTN; PAM sequence: TTT
gtgacattgcccaggctggt

SEQ ID NO: 27496 - DNA, 20 bp, Artificial Sequence
  Description of Artificial Sequence: Synthetic oligonucleotide
  Target: FXN; (-) strand; PAM type: YTN; PAM sequence: CTT
tgtgacattgcccaggctgg

SEQ ID NO: 27497 - DNA, 20 bp, Artificial Sequence
  Description of Artificial Sequence: Synthetic oligonucleotide
  Target: FXN; (-) strand; PAM type: YTN; PAM sequence: TTA
gtagaggtggggctttgtga

SEQ ID NO: 27498 - DNA, 20 bp, Artificial Sequence
  Description of Artificial Sequence: Synthetic oligonucleotide
  Target: FXN; (-) strand; PAM type: YTN; PAM sequence: TTT
agtagaggtggggctttgtg

SEQ ID NO: 27499 - DNA, 20 bp, Artificial Sequence
  Description of Artificial Sequence: Synthetic oligonucleotide
  Target: FXN; (-) strand; PAM type: YTN; PAM sequence: TTT
tagtagaggtggggctttgt

SEQ ID NO: 27500 - DNA, 20 bp, Artificial Sequence
  Description of Artificial Sequence: Synthetic oligonucleotide
  Target: FXN; (-) strand; PAM type: YTN; PAM sequence: TTT
ttagtagaggtggggctttg

SEQ ID NO: 27501 - DNA, 20 bp, Artificial Sequence
  Description of Artificial Sequence: Synthetic oligonucleotide
  Target: FXN; (-) strand; PAM type: YTN; PAM sequence: TTA
tatttttagtagaggtgggg

SEQ ID NO: 27502 - DNA, 20 bp, Artificial Sequence
  Description of Artificial Sequence: Synthetic oligonucleotide
  Target: FXN; (-) strand; PAM type: YTN; PAM sequence: TTT
atatttttagtagaggtggg

SEQ ID NO: 27503 - DNA, 20 bp, Artificial Sequence
  Description of Artificial Sequence: Synthetic oligonucleotide
  Target: FXN; (-) strand; PAM type: YTN; PAM sequence: TTT
tatatttttagtagaggtgg

SEQ ID NO: 27504 - DNA, 20 bp, Artificial Sequence
  Description of Artificial Sequence: Synthetic oligonucleotide
  Target: FXN; (-) strand; PAM type: YTN; PAM sequence: TTT
ttatatttttagtagaggtg

SEQ ID NO: 27505 - DNA, 20 bp, Artificial Sequence
  Description of Artificial Sequence: Synthetic oligonucleotide
  Target: FXN; (-) strand; PAM type: YTN; PAM sequence: CTA
atttttatatttttagtaga

SEQ ID NO: 27506 - DNA, 20 bp, Artificial Sequence
  Description of Artificial Sequence: Synthetic oligonucleotide
  Target: FXN; (-) strand; PAM type: YTN; PAM sequence: CTG
gctaatttttatatttttag

SEQ ID NO: 27507 - DNA, 20 bp, Artificial Sequence
  Description of Artificial Sequence: Synthetic oligonucleotide
  Target: FXN; (-) strand; PAM type: YTN; PAM sequence: CTA
taggcgtgtgccaccacacc

SEQ ID NO: 27508 - DNA, 20 bp, Artificial Sequence
  Description of Artificial Sequence: Synthetic oligonucleotide
  Target: FXN; (-) strand; PAM type: YTN; PAM sequence: TTG
ggactataggcgtgtgccac

SEQ ID NO: 27509 - DNA, 20 bp, Artificial Sequence
  Description of Artificial Sequence: Synthetic oligonucleotide
  Target: FXN; (-) strand; PAM type: YTN; PAM sequence: TTC
caagtagttgggactatagg

SEQ ID NO: 27510 - DNA, 20 bp, Artificial Sequence
  Description of Artificial Sequence: Synthetic oligonucleotide
  Target: FXN; (-) strand; PAM type: YTN; PAM sequence: CTT
ccaagtagttgggactatag

SEQ ID NO: 27511 - DNA, 20 bp, Artificial Sequence
  Description of Artificial Sequence: Synthetic oligonucleotide
  Target: FXN; (-) strand; PAM type: YTN; PAM sequence: CTC
agccttccaagtagttggga

SEQ ID NO: 27512 - DNA, 20 bp, Artificial Sequence
  Description of Artificial Sequence: Synthetic oligonucleotide
  Target: FXN; (-) strand; PAM type: YTN; PAM sequence: CTC
aacctcagccttccaagtag

SEQ ID NO: 27513 - DNA, 20 bp, Artificial Sequence
  Description of Artificial Sequence: Synthetic oligonucleotide
  Target: FXN; (-) strand; PAM type: YTN; PAM sequence: CTG
aggctcaacctcagccttcc

SEQ ID NO: 27514 - DNA, 20 bp, Artificial Sequence
  Description of Artificial Sequence: Synthetic oligonucleotide
  Target: FXN; (-) strand; PAM type: YTN; PAM sequence: CTC
aggctgaggctcaacctcag

SEQ ID NO: 27515 - DNA, 20 bp, Artificial Sequence
  Description of Artificial Sequence: Synthetic oligonucleotide
  Target: FXN; (-) strand; PAM type: YTN; PAM sequence: CTG
ggctcaggctgaggctcaac

SEQ ID NO: 27516 - DNA, 20 bp, Artificial Sequence
  Description of Artificial Sequence: Synthetic oligonucleotide
  Target: FXN; (-) strand; PAM type: YTN; PAM sequence: CTC
ctgggctcaggctgaggctc

SEQ ID NO: 27517 - DNA, 20 bp, Artificial Sequence
  Description of Artificial Sequence: Synthetic oligonucleotide
  Target: FXN; (-) strand; PAM type: YTN; PAM sequence: CTC
cacctcctgggctcaggctg

SEQ ID NO: 27518 - DNA, 20 bp, Artificial Sequence
  Description of Artificial Sequence: Synthetic oligonucleotide
  Target: FXN; (-) strand; PAM type: YTN; PAM sequence: CTG
caacctccacctcctgggct

SEQ ID NO: 27519 - DNA, 20 bp, Artificial Sequence
  Description of Artificial Sequence: Synthetic oligonucleotide
  Target: FXN; (-) strand; PAM type: YTN; PAM sequence: CTC
actgcaacctccacctcctg

SEQ ID NO: 27520 - DNA, 20 bp, Artificial Sequence
  Description of Artificial Sequence: Synthetic oligonucleotide
  Target: FXN; (-) strand; PAM type: YTN; PAM sequence: TTG
gctcactgcaacctccacct

SEQ ID NO: 27521 - DNA, 20 bp, Artificial Sequence
  Description of Artificial Sequence: Synthetic oligonucleotide
  Target: FXN; (-) strand; PAM type: YTN; PAM sequence: CTT
ggctcactgcaacctccacc

SEQ ID NO: 27522 - DNA, 20 bp, Artificial Sequence
  Description of Artificial Sequence: Synthetic oligonucleotide
  Target: FXN; (-) strand; PAM type: YTN; PAM sequence: CTG
gagtgcagtggcgcgatctt

SEQ ID NO: 27523 - DNA, 20 bp, Artificial Sequence
  Description of Artificial Sequence: Synthetic oligonucleotide
  Target: FXN; (-) strand; PAM type: YTN; PAM sequence: TTG
cccaggctggagtgcagtgg

SEQ ID NO: 27524 - DNA, 20 bp, Artificial Sequence
  Description of Artificial Sequence: Synthetic oligonucleotide
  Target: FXN; (-) strand; PAM type: YTN; PAM sequence: CTG
ttgcccaggctggagtgcag

SEQ ID NO: 27525 - DNA, 20 bp, Artificial Sequence
  Description of Artificial Sequence: Synthetic oligonucleotide
  Target: FXN; (-) strand; PAM type: YTN; PAM sequence: CTG
gccctgttgcccaggctgga

SEQ ID NO: 27526 - DNA, 20 bp, Artificial Sequence
  Description of Artificial Sequence: Synthetic oligonucleotide
  Target: FXN; (-) strand; PAM type: YTN; PAM sequence: TTG
ggacagggtctggccctgtt

SEQ ID NO: 27527 - DNA, 20 bp, Artificial Sequence
  Description of Artificial Sequence: Synthetic oligonucleotide
  Target: FXN; (-) strand; PAM type: YTN; PAM sequence: TTT
gggacagggtctggccctgt

SEQ ID NO: 27528 - DNA, 20 bp, Artificial Sequence
  Description of Artificial Sequence: Synthetic oligonucleotide
  Target: FXN; (-) strand; PAM type: YTN; PAM sequence: TTT
tgggacagggtctggccctg

SEQ ID NO: 27529 - DNA, 20 bp, Artificial Sequence
  Description of Artificial Sequence: Synthetic oligonucleotide
  Target: FXN; (-) strand; PAM type: YTN; PAM sequence: TTT
ttgggacagggtctggccct

SEQ ID NO: 27530 - DNA, 20 bp, Artificial Sequence
  Description of Artificial Sequence: Synthetic oligonucleotide
  Target: FXN; (-) strand; PAM type: YTN; PAM sequence: TTT
tttgggacagggtctggccc

SEQ ID NO: 27531 - DNA, 20 bp, Artificial Sequence
  Description of Artificial Sequence: Synthetic oligonucleotide
  Target: FXN; (-) strand; PAM type: YTN; PAM sequence: TTT
ttttgggacagggtctggcc

SEQ ID NO: 27532 - DNA, 20 bp, Artificial Sequence
  Description of Artificial Sequence: Synthetic oligonucleotide
  Target: FXN; (-) strand; PAM type: YTN; PAM sequence: TTT
tttttgggacagggtctggc

SEQ ID NO: 27533 - DNA, 20 bp, Artificial Sequence
  Description of Artificial Sequence: Synthetic oligonucleotide
  Target: FXN; (-) strand; PAM type: YTN; PAM sequence: TTT
ttttttgggacagggtctgg

SEQ ID NO: 27534 - DNA, 20 bp, Artificial Sequence
  Description of Artificial Sequence: Synthetic oligonucleotide
  Target: FXN; (-) strand; PAM type: YTN; PAM sequence: TTT
tttttttgggacagggtctg

SEQ ID NO: 27535 - DNA, 20 bp, Artificial Sequence
  Description of Artificial Sequence: Synthetic oligonucleotide
  Target: FXN; (-) strand; PAM type: YTN; PAM sequence: TTT
ttttttttgggacagggtct

SEQ ID NO: 27536 - DNA, 20 bp, Artificial Sequence
  Description of Artificial Sequence: Synthetic oligonucleotide
  Target: FXN; (-) strand; PAM type: YTN; PAM sequence: TTT
tttttttttgggacagggtc

SEQ ID NO: 27537 - DNA, 20 bp, Artificial Sequence
  Description of Artificial Sequence: Synthetic oligonucleotide
  Target: FXN; (-) strand; PAM type: YTN; PAM sequence: TTT
ttttttttttgggacagggt

SEQ ID NO: 27538 - DNA, 20 bp, Artificial Sequence
  Description of Artificial Sequence: Synthetic oligonucleotide
  Target: FXN; (-) strand; PAM type: YTN; PAM sequence: TTT
tttttttttttgggacaggg

SEQ ID NO: 27539 - DNA, 20 bp, Artificial Sequence
  Description of Artificial Sequence: Synthetic oligonucleotide
  Target: FXN; (-) strand; PAM type: YTN; PAM sequence: TTT
ttttttttttttgggacagg

SEQ ID NO: 27540 - DNA, 20 bp, Artificial Sequence
  Description of Artificial Sequence: Synthetic oligonucleotide
  Target: FXN; (-) strand; PAM type: YTN; PAM sequence: CTT
tttttttttttttgggacag

SEQ ID NO: 27541 - DNA, 20 bp, Artificial Sequence
  Description of Artificial Sequence: Synthetic oligonucleotide
  Target: FXN; (-) strand; PAM type: YTN; PAM sequence: CTA
acataagacgatgacttttt

SEQ ID NO: 27542 - DNA, 20 bp, Artificial Sequence
  Description of Artificial Sequence: Synthetic oligonucleotide
  Target: FXN; (-) strand; PAM type: YTN; PAM sequence: TTA
caaggatgctaacataagac

SEQ ID NO: 27543 - DNA, 20 bp, Artificial Sequence
  Description of Artificial Sequence: Synthetic oligonucleotide
  Target: FXN; (-) strand; PAM type: YTN; PAM sequence: CTT
acaaggatgctaacataaga

SEQ ID NO: 27544 - DNA, 20 bp, Artificial Sequence
  Description of Artificial Sequence: Synthetic oligonucleotide
  Target: FXN; (-) strand; PAM type: YTN; PAM sequence: CTC
acttacaaggatgctaacat

SEQ ID NO: 27545 - DNA, 20 bp, Artificial Sequence
  Description of Artificial Sequence: Synthetic oligonucleotide
  Target: FXN; (-) strand; PAM type: YTN; PAM sequence: CTG
caaaatatcaggaaaggctc

SEQ ID NO: 27546 - DNA, 20 bp, Artificial Sequence
  Description of Artificial Sequence: Synthetic oligonucleotide
  Target: FXN; (-) strand; PAM type: YTN; PAM sequence: CTG
agaatgagacaggctgcaaa

SEQ ID NO: 27547 - DNA, 20 bp, Artificial Sequence
  Description of Artificial Sequence: Synthetic oligonucleotide
  Target: FXN; (-) strand; PAM type: YTN; PAM sequence: CTA
ctgagaatgagacaggctgc

SEQ ID NO: 27548 - DNA, 20 bp, Artificial Sequence
  Description of Artificial Sequence: Synthetic oligonucleotide
  Target: FXN; (-) strand; PAM type: YTN; PAM sequence: TTC
tactgagaatgagacaggct

SEQ ID NO: 27549 - DNA, 20 bp, Artificial Sequence
  Description of Artificial Sequence: Synthetic oligonucleotide
  Target: FXN; (-) strand; PAM type: YTN; PAM sequence: TTT
ctactgagaatgagacaggc

SEQ ID NO: 27550 - DNA, 20 bp, Artificial Sequence
  Description of Artificial Sequence: Synthetic oligonucleotide
  Target: FXN; (-) strand; PAM type: YTN; PAM sequence: TTT
tctactgagaatgagacagg

SEQ ID NO: 27551 - DNA, 20 bp, Artificial Sequence
  Description of Artificial Sequence: Synthetic oligonucleotide
  Target: FXN; (-) strand; PAM type: YTN; PAM sequence: CTT
ttctactgagaatgagacag

SEQ ID NO: 27552 - DNA, 20 bp, Artificial Sequence
  Description of Artificial Sequence: Synthetic oligonucleotide
  Target: FXN; (-) strand; PAM type: YTN; PAM sequence: CTA
gagtaaacttttctactgag

SEQ ID NO: 27553 - DNA, 20 bp, Artificial Sequence
  Description of Artificial Sequence: Synthetic oligonucleotide
  Target: FXN; (-) strand; PAM type: YTN; PAM sequence: TTA
tgtaactagagtaaactttt

SEQ ID NO: 27554 - DNA, 20 bp, Artificial Sequence
  Description of Artificial Sequence: Synthetic oligonucleotide
  Target: FXN; (-) strand; PAM type: YTN; PAM sequence: TTG
tcagcagggagaagttatgt

SEQ ID NO: 27555 - DNA, 20 bp, Artificial Sequence
  Description of Artificial Sequence: Synthetic oligonucleotide
  Target: FXN; (-) strand; PAM type: YTN; PAM sequence: TTA
cagtatccaaattgtcagca

SEQ ID NO: 27556 - DNA, 20 bp, Artificial Sequence
  Description of Artificial Sequence: Synthetic oligonucleotide
  Target: FXN; (-) strand; PAM type: YTN; PAM sequence: CTT
acagtatccaaattgtcagc

SEQ ID NO: 27557 - DNA, 20 bp, Artificial Sequence
  Description of Artificial Sequence: Synthetic oligonucleotide
  Target: FXN; (-) strand; PAM type: YTN; PAM sequence: CTG
cttacagtatccaaattgtc

SEQ ID NO: 27558 - DNA, 20 bp, Artificial Sequence
  Description of Artificial Sequence: Synthetic oligonucleotide
  Target: FXN; (-) strand; PAM type: YTN; PAM sequence: CTG
atgcctgcttacagtatcca

SEQ ID NO: 27559 - DNA, 20 bp, Artificial Sequence
  Description of Artificial Sequence: Synthetic oligonucleotide
  Target: FXN; (-) strand; PAM type: YTN; PAM sequence: TTA
atatcctgatgcctgcttac

SEQ ID NO: 27560 - DNA, 20 bp, Artificial Sequence
  Description of Artificial Sequence: Synthetic oligonucleotide
  Target: FXN; (-) strand; PAM type: YTN; PAM sequence: CTT
aatatcctgatgcctgctta

SEQ ID NO: 27561 - DNA, 20 bp, Artificial Sequence
  Description of Artificial Sequence: Synthetic oligonucleotide
  Target: FXN; (-) strand; PAM type: YTN; PAM sequence: TTC
agatcttaatatcctgatgc

SEQ ID NO: 27562 - DNA, 20 bp, Artificial Sequence
  Description of Artificial Sequence: Synthetic oligonucleotide
  Target: FXN; (-) strand; PAM type: YTN; PAM sequence: CTT
cagatcttaatatcctgatg

SEQ ID NO: 27563 - DNA, 20 bp, Artificial Sequence
  Description of Artificial Sequence: Synthetic oligonucleotide
  Target: FXN; (-) strand; PAM type: YTN; PAM sequence: CTC
acttcagatcttaatatcct

SEQ ID NO: 27564 - DNA, 20 bp, Artificial Sequence
  Description of Artificial Sequence: Synthetic oligonucleotide
  Target: FXN; (-) strand; PAM type: YTN; PAM sequence: CTA
ctcacttcagatcttaatat

SEQ ID NO: 27565 - DNA, 20 bp, Artificial Sequence
  Description of Artificial Sequence: Synthetic oligonucleotide
  Target: FXN; (-) strand; PAM type: YTN; PAM sequence: TTA
taagctactcacttcagatc

SEQ ID NO: 27566 - DNA, 20 bp, Artificial Sequence
  Description of Artificial Sequence: Synthetic oligonucleotide
  Target: FXN; (-) strand; PAM type: YTN; PAM sequence: TTG
gaaaagttataagctactca

SEQ ID NO: 27567 - DNA, 20 bp, Artificial Sequence
  Description of Artificial Sequence: Synthetic oligonucleotide
  Target: FXN; (-) strand; PAM type: YTN; PAM sequence: TTT
ggaaaagttataagctactc

SEQ ID NO: 27568 - DNA, 20 bp, Artificial Sequence
  Description of Artificial Sequence: Synthetic oligonucleotide
  Target: FXN; (-) strand; PAM type: YTN; PAM sequence: CTG
gatttggaaaagttataagc

SEQ ID NO: 27569 - DNA, 20 bp, Artificial Sequence
  Description of Artificial Sequence: Synthetic oligonucleotide
  Target: FXN; (-) strand; PAM type: YTN; PAM sequence: CTA
ggctggatttggaaaagtta

SEQ ID NO: 27570 - DNA, 20 bp, Artificial Sequence
  Description of Artificial Sequence: Synthetic oligonucleotide
  Target: FXN; (-) strand; PAM type: YTN; PAM sequence: CTG
tctaggctggatttggaaaa

SEQ ID NO: 27571 - DNA, 20 bp, Artificial Sequence
  Description of Artificial Sequence: Synthetic oligonucleotide
  Target: FXN; (-) strand; PAM type: YTN; PAM sequence: TTA
atagaggaaaactgtctagg

SEQ ID NO: 27572 - DNA, 20 bp, Artificial Sequence
  Description of Artificial Sequence: Synthetic oligonucleotide
  Target: FXN; (-) strand; PAM type: YTN; PAM sequence: TTT
aatagaggaaaactgtctag

SEQ ID NO: 27573 - DNA, 20 bp, Artificial Sequence
  Description of Artificial Sequence: Synthetic oligonucleotide
  Target: FXN; (-) strand; PAM type: YTN; PAM sequence: TTA
aagtcagggcaataatttaa

SEQ ID NO: 27574 - DNA, 20 bp, Artificial Sequence
  Description of Artificial Sequence: Synthetic oligonucleotide
  Target: FXN; (-) strand; PAM type: YTN; PAM sequence: TTT
aaagtcagggcaataattta

SEQ ID NO: 27575 - DNA, 20 bp, Artificial Sequence
  Description of Artificial Sequence: Synthetic oligonucleotide
  Target: FXN; (-) strand; PAM type: YTN; PAM sequence: TTT
taaagtcagggcaataattt

SEQ ID NO: 27576 - DNA, 20 bp, Artificial Sequence
  Description of Artificial Sequence: Synthetic oligonucleotide
  Target: FXN; (-) strand; PAM type: YTN; PAM sequence: CTT
ttaaagtcagggcaataatt

SEQ ID NO: 27577 - DNA, 20 bp, Artificial Sequence
  Description of Artificial Sequence: Synthetic oligonucleotide
  Target: FXN; (-) strand; PAM type: YTN; PAM sequence: TTC
ttttaaagtcagggcaataa

SEQ ID NO: 27578 - DNA, 20 bp, Artificial Sequence
  Description of Artificial Sequence: Synthetic oligonucleotide
  Target: FXN; (-) strand; PAM type: YTN; PAM sequence: CTT
cttttaaagtcagggcaata

SEQ ID NO: 27579 - DNA, 20 bp, Artificial Sequence
  Description of Artificial Sequence: Synthetic oligonucleotide
  Target: FXN; (-) strand; PAM type: YTN; PAM sequence: CTA
caaggtcaaaagtagcttct

SEQ ID NO: 27580 - DNA, 20 bp, Artificial Sequence
  Description of Artificial Sequence: Synthetic oligonucleotide
  Target: FXN; (-) strand; PAM type: YTN; PAM sequence: TTC
aaacgctacaaggtcaaaag

SEQ ID NO: 27581 - DNA, 20 bp, Artificial Sequence
  Description of Artificial Sequence: Synthetic oligonucleotide
  Target: FXN; (-) strand; PAM type: YTN; PAM sequence: TTG
ttcaaacgctacaaggtcaa

SEQ ID NO: 27582 - DNA, 20 bp, Artificial Sequence
  Description of Artificial Sequence: Synthetic oligonucleotide
  Target: FXN; (-) strand; PAM type: YTN; PAM sequence: CTT
gttcaaacgctacaaggtca

SEQ ID NO: 27583 - DNA, 20 bp, Artificial Sequence
  Description of Artificial Sequence: Synthetic oligonucleotide
  Target: FXN; (-) strand; PAM type: YTN; PAM sequence: TTG
aagacaaagtgcaacttgtt

SEQ ID NO: 27584 - DNA, 20 bp, Artificial Sequence
  Description of Artificial Sequence: Synthetic oligonucleotide
  Target: FXN; (-) strand; PAM type: YTN; PAM sequence: TTT
gaagacaaagtgcaacttgt

SEQ ID NO: 27585 - DNA, 20 bp, Artificial Sequence
  Description of Artificial Sequence: Synthetic oligonucleotide
  Target: FXN; (-) strand; PAM type: YTN; PAM sequence: CTT
tgaagacaaagtgcaacttg

SEQ ID NO: 27586 - DNA, 20 bp, Artificial Sequence
  Description of Artificial Sequence: Synthetic oligonucleotide
  Target: FXN; (-) strand; PAM type: YTN; PAM sequence: TTG
ctttgaagacaaagtgcaac

SEQ ID NO: 27587 - DNA, 20 bp, Artificial Sequence
  Description of Artificial Sequence: Synthetic oligonucleotide
  Target: FXN; (-) strand; PAM type: YTN; PAM sequence: CTT
gctttgaagacaaagtgcaa

SEQ ID NO: 27588 - DNA, 20 bp, Artificial Sequence
  Description of Artificial Sequence: Synthetic oligonucleotide
  Target: FXN; (-) strand; PAM type: YTN; PAM sequence: TTA
acttgctttgaagacaaagt

SEQ ID NO: 27589 - DNA, 20 bp, Artificial Sequence
  Description of Artificial Sequence: Synthetic oligonucleotide
  Target: FXN; (-) strand; PAM type: YTN; PAM sequence: TTT
aacttgctttgaagacaaag

SEQ ID NO: 27590 - DNA, 20 bp, Artificial Sequence
  Description of Artificial Sequence: Synthetic oligonucleotide
  Target: FXN; (-) strand; PAM type: YTN; PAM sequence: CTT
taacttgctttgaagacaaa

SEQ ID NO: 27591 - DNA, 20 bp, Artificial Sequence
  Description of Artificial Sequence: Synthetic oligonucleotide
  Target: FXN; (-) strand; PAM type: YTN; PAM sequence: CTC
aaaacaagtagaggtcaaac

SEQ ID NO: 27592 - DNA, 20 bp, Artificial Sequence
  Description of Artificial Sequence: Synthetic oligonucleotide
  Target: FXN; (-) strand; PAM type: YTN; PAM sequence: CTG
agaggctcaaaacaagtaga

SEQ ID NO: 27593 - DNA, 20 bp, Artificial Sequence
  Description of Artificial Sequence: Synthetic oligonucleotide
  Target: FXN; (-) strand; PAM type: YTN; PAM sequence: TTA
cctgagaggctcaaaacaag

SEQ ID NO: 27594 - DNA, 20 bp, Artificial Sequence
  Description of Artificial Sequence: Synthetic oligonucleotide
  Target: FXN; (-) strand; PAM type: YTN; PAM sequence: TTT
acctgagaggctcaaaacaa

SEQ ID NO: 27595 - DNA, 20 bp, Artificial Sequence
  Description of Artificial Sequence: Synthetic oligonucleotide
  Target: FXN; (-) strand; PAM type: YTN; PAM sequence: CTT
tacctgagaggctcaaaaca

SEQ ID NO: 27596 - DNA, 20 bp, Artificial Sequence
  Description of Artificial Sequence: Synthetic oligonucleotide
  Target: FXN; (-) strand; PAM type: YTN; PAM sequence: TTC
aaataaccctttacctgaga

SEQ ID NO: 27597 - DNA, 20 bp, Artificial Sequence
  Description of Artificial Sequence: Synthetic oligonucleotide
  Target: FXN; (-) strand; PAM type: YTN; PAM sequence: CTG
caaagggaattcaaataacc

SEQ ID NO: 27598 - DNA, 20 bp, Artificial Sequence
  Description of Artificial Sequence: Synthetic oligonucleotide
  Target: FXN; (-) strand; PAM type: YTN; PAM sequence: CTC
cacagggtacacaaccccaa

SEQ ID NO: 27599 - DNA, 20 bp, Artificial Sequence
  Description of Artificial Sequence: Synthetic oligonucleotide
  Target: FXN; (-) strand; PAM type: YTN; PAM sequence: CTA
ccacctccacagggtacaca

SEQ ID NO: 27600 - DNA, 20 bp, Artificial Sequence
  Description of Artificial Sequence: Synthetic oligonucleotide
  Target: FXN; (-) strand; PAM type: YTN; PAM sequence: CTC
taccacctccacagggtaca

SEQ ID NO: 27601 - DNA, 20 bp, Artificial Sequence
  Description of Artificial Sequence: Synthetic oligonucleotide
  Target: FXN; (-) strand; PAM type: YTN; PAM sequence: CTG
gagcagcaatatataacact

SEQ ID NO: 27602 - DNA, 20 bp, Artificial Sequence
  Description of Artificial Sequence: Synthetic oligonucleotide
  Target: FXN; (-) strand; PAM type: YTN; PAM sequence: TTA
aatgccctggagcagcaata

SEQ ID NO: 27603 - DNA, 20 bp, Artificial Sequence
  Description of Artificial Sequence: Synthetic oligonucleotide
  Target: FXN; (-) strand; PAM type: YTN; PAM sequence: TTG
aaagcacatcaatggaaaag

SEQ ID NO: 27604 - DNA, 20 bp, Artificial Sequence
  Description of Artificial Sequence: Synthetic oligonucleotide
  Target: FXN; (-) strand; PAM type: YTN; PAM sequence: CTA
gattgaaagcacatcaatgg

SEQ ID NO: 27605 - DNA, 20 bp, Artificial Sequence
  Description of Artificial Sequence: Synthetic oligonucleotide
  Target: FXN; (-) strand; PAM type: YTN; PAM sequence: CTC
tagattgaaagcacatcaat

SEQ ID NO: 27606 - DNA, 20 bp, Artificial Sequence
  Description of Artificial Sequence: Synthetic oligonucleotide
  Target: FXN; (-) strand; PAM type: YTN; PAM sequence: TTC
ctctagattgaaagcacatc

SEQ ID NO: 27607 - DNA, 20 bp, Artificial Sequence
  Description of Artificial Sequence: Synthetic oligonucleotide
  Target: FXN; (-) strand; PAM type: YTN; PAM sequence: TTA
ttcctctagattgaaagcac

SEQ ID NO: 27608 - DNA, 20 bp, Artificial Sequence
  Description of Artificial Sequence: Synthetic oligonucleotide
  Target: FXN; (-) strand; PAM type: YTN; PAM sequence: TTT
attcctctagattgaaagca

SEQ ID NO: 27609 - DNA, 20 bp, Artificial Sequence
  Description of Artificial Sequence: Synthetic oligonucleotide
  Target: FXN; (-) strand; PAM type: YTN; PAM sequence: TTT
tattcctctagattgaaagc

SEQ ID NO: 27610 - DNA, 20 bp, Artificial Sequence
  Description of Artificial Sequence: Synthetic oligonucleotide
  Target: FXN; (-) strand; PAM type: YTN; PAM sequence: CTT
ttattcctctagattgaaag

SEQ ID NO: 27611 - DNA, 20 bp, Artificial Sequence
  Description of Artificial Sequence: Synthetic oligonucleotide
  Target: FXN; (-) strand; PAM type: YTN; PAM sequence: CTC
caacacaatcttttattcct

SEQ ID NO: 27612 - DNA, 20 bp, Artificial Sequence
  Description of Artificial Sequence: Synthetic oligonucleotide
  Target: FXN; (-) strand; PAM type: YTN; PAM sequence: TTG
tgtctccaacacaatctttt

SEQ ID NO: 27613 - DNA, 20 bp, Artificial Sequence
  Description of Artificial Sequence: Synthetic oligonucleotide
  Target: FXN; (-) strand; PAM type: YTN; PAM sequence: CTA
tgcaggccacattgtgtctc

SEQ ID NO: 27614 - DNA, 20 bp, Artificial Sequence
  Description of Artificial Sequence: Synthetic oligonucleotide
  Target: FXN; (-) strand; PAM type: YTN; PAM sequence: TTC
agatgctatgcaggccacat

SEQ ID NO: 27615 - DNA, 20 bp, Artificial Sequence
  Description of Artificial Sequence: Synthetic oligonucleotide
  Target: FXN; (-) strand; PAM type: YTN; PAM sequence: TTT
cagatgctatgcaggccaca

SEQ ID NO: 27616 - DNA, 20 bp, Artificial Sequence
  Description of Artificial Sequence: Synthetic oligonucleotide
  Target: FXN; (-) strand; PAM type: YTN; PAM sequence: CTT
tcagatgctatgcaggccac

SEQ ID NO: 27617 - DNA, 20 bp, Artificial Sequence
  Description of Artificial Sequence: Synthetic oligonucleotide
  Target: FXN; (-) strand; PAM type: YTN; PAM sequence: CTC
aggctttcagatgctatgca

SEQ ID NO: 27618 - DNA, 20 bp, Artificial Sequence
  Description of Artificial Sequence: Synthetic oligonucleotide
  Target: FXN; (-) strand; PAM type: YTN; PAM sequence: TTC
tcaggctttcagatgctatg

SEQ ID NO: 27619 - DNA, 20 bp, Artificial Sequence
  Description of Artificial Sequence: Synthetic oligonucleotide
  Target: FXN; (-) strand; PAM type: YTN; PAM sequence: CTG
catgttctcaggctttcaga

SEQ ID NO: 27620 - DNA, 20 bp, Artificial Sequence
  Description of Artificial Sequence: Synthetic oligonucleotide
  Target: FXN; (-) strand; PAM type: YTN; PAM sequence: CTC
cctgcatgttctcaggcttt

SEQ ID NO: 27621 - DNA, 20 bp, Artificial Sequence
  Description of Artificial Sequence: Synthetic oligonucleotide
  Target: FXN; (-) strand; PAM type: YTN; PAM sequence: CTC
tccctgcatgttctcaggct

SEQ ID NO: 27622 - DNA, 20 bp, Artificial Sequence
  Description of Artificial Sequence: Synthetic oligonucleotide
  Target: FXN; (-) strand; PAM type: YTN; PAM sequence: CTG
agggatgagggatgtctctc

SEQ ID NO: 27623 - DNA, 20 bp, Artificial Sequence
  Description of Artificial Sequence: Synthetic oligonucleotide
  Target: FXN; (-) strand; PAM type: YTN; PAM sequence: CTG
ctgagggatgagggatgtct

SEQ ID NO: 27624 - DNA, 20 bp, Artificial Sequence
  Description of Artificial Sequence: Synthetic oligonucleotide
  Target: FXN; (-) strand; PAM type: YTN; PAM sequence: TTC
aacagcagccaggctgctga

SEQ ID NO: 27625 - DNA, 20 bp, Artificial Sequence
  Description of Artificial Sequence: Synthetic oligonucleotide
  Target: FXN; (-) strand; PAM type: YTN; PAM sequence: CTT
caacagcagccaggctgctg

SEQ ID NO: 27626 - DNA, 20 bp, Artificial Sequence
  Description of Artificial Sequence: Synthetic oligonucleotide
  Target: FXN; (-) strand; PAM type: YTN; PAM sequence: TTA
caaccacttcaacagcagcc

SEQ ID NO: 27627 - DNA, 20 bp, Artificial Sequence
  Description of Artificial Sequence: Synthetic oligonucleotide
  Target: FXN; (-) strand; PAM type: YTN; PAM sequence: CTT
acaaccacttcaacagcagc

SEQ ID NO: 27628 - DNA, 20 bp, Artificial Sequence
  Description of Artificial Sequence: Synthetic oligonucleotide
  Target: FXN; (-) strand; PAM type: YTN; PAM sequence: TTC
ttacaaccacttcaacagca

SEQ ID NO: 27629 - DNA, 20 bp, Artificial Sequence
  Description of Artificial Sequence: Synthetic oligonucleotide
  Target: FXN; (-) strand; PAM type: YTN; PAM sequence: TTT
cttacaaccacttcaacagc

SEQ ID NO: 27630 - DNA, 20 bp, Artificial Sequence
  Description of Artificial Sequence: Synthetic oligonucleotide
  Target: FXN; (-) strand; PAM type: YTN; PAM sequence: CTT
tcttacaaccacttcaacag

SEQ ID NO: 27631 - DNA, 20 bp, Artificial Sequence
  Description of Artificial Sequence: Synthetic oligonucleotide
  Target: FXN; (-) strand; PAM type: YTN; PAM sequence: TTA
ctttcttacaaccacttcaa

SEQ ID NO: 27632 - DNA, 20 bp, Artificial Sequence
  Description of Artificial Sequence: Synthetic oligonucleotide
  Target: FXN; (-) strand; PAM type: YTN; PAM sequence: TTT
actttcttacaaccacttca

SEQ ID NO: 27633 - DNA, 20 bp, Artificial Sequence
  Description of Artificial Sequence: Synthetic oligonucleotide
  Target: FXN; (-) strand; PAM type: YTN; PAM sequence: TTT
tactttcttacaaccacttc

SEQ ID NO: 27634 - DNA, 20 bp, Artificial Sequence
  Description of Artificial Sequence: Synthetic oligonucleotide
  Target: FXN; (-) strand; PAM type: YTN; PAM sequence: CTT
ttactttcttacaaccactt

SEQ ID NO: 27635 - DNA, 20 bp, Artificial Sequence
  Description of Artificial Sequence: Synthetic oligonucleotide
  Target: FXN; (-) strand; PAM type: YTN; PAM sequence: CTC
ttttactttcttacaaccac

SEQ ID NO: 27636 - DNA, 20 bp, Artificial Sequence
  Description of Artificial Sequence: Synthetic oligonucleotide
  Target: FXN; (-) strand; PAM type: YTN; PAM sequence: TTC
tcttttactttcttacaacc

SEQ ID NO: 27637 - DNA, 20 bp, Artificial Sequence
  Description of Artificial Sequence: Synthetic oligonucleotide
  Target: FXN; (-) strand; PAM type: YTN; PAM sequence: TTT
ctcttttactttcttacaac

SEQ ID NO: 27638 - DNA, 20 bp, Artificial Sequence
  Description of Artificial Sequence: Synthetic oligonucleotide
  Target: FXN; (-) strand; PAM type: YTN; PAM sequence: TTG
tgggcatttctcttttactt

SEQ ID NO: 27639 - DNA, 20 bp, Artificial Sequence
  Description of Artificial Sequence: Synthetic oligonucleotide
  Target: FXN; (-) strand; PAM type: YTN; PAM sequence: TTT
gtgggcatttctcttttact

SEQ ID NO: 27640 - DNA, 20 bp, Artificial Sequence
  Description of Artificial Sequence: Synthetic oligonucleotide
  Target: FXN; (-) strand; PAM type: YTN; PAM sequence: TTT
tgtgggcatttctcttttac

SEQ ID NO: 27641 - DNA, 20 bp, Artificial Sequence
  Description of Artificial Sequence: Synthetic oligonucleotide
  Target: FXN; (-) strand; PAM type: YTN; PAM sequence: CTG
agaacgttttgtgggcattt

SEQ ID NO: 27642 - DNA, 20 bp, Artificial Sequence
  Description of Artificial Sequence: Synthetic oligonucleotide
  Target: FXN; (-) strand; PAM type: YTN; PAM sequence: CTG
gatctgagaacgttttgtgg

SEQ ID NO: 27643 - DNA, 20 bp, Artificial Sequence
  Description of Artificial Sequence: Synthetic oligonucleotide
  Target: FXN; (-) strand; PAM type: YTN; PAM sequence: CTA
atgaatgactggatctgaga

SEQ ID NO: 27644 - DNA, 20 bp, Artificial Sequence
  Description of Artificial Sequence: Synthetic oligonucleotide
  Target: FXN; (-) strand; PAM type: YTN; PAM sequence: TTG
gaagtgctaatgaatgactg

SEQ ID NO: 27645 - DNA, 20 bp, Artificial Sequence
  Description of Artificial Sequence: Synthetic oligonucleotide
  Target: FXN; (-) strand; PAM type: YTN; PAM sequence: TTT
ggaagtgctaatgaatgact

SEQ ID NO: 27646 - DNA, 20 bp, Artificial Sequence
  Description of Artificial Sequence: Synthetic oligonucleotide
  Target: FXN; (-) strand; PAM type: YTN; PAM sequence: CTT
tggaagtgctaatgaatgac

SEQ ID NO: 27647 - DNA, 20 bp, Artificial Sequence
  Description of Artificial Sequence: Synthetic oligonucleotide
  Target: FXN; (-) strand; PAM type: YTN; PAM sequence: CTC
tttggaagtgctaatgaatg

SEQ ID NO: 27648 - DNA, 20 bp, Artificial Sequence
  Description of Artificial Sequence: Synthetic oligonucleotide
  Target: FXN; (-) strand; PAM type: YTN; PAM sequence: CTC
tctttggaagtgctaatgaa

SEQ ID NO: 27649 - DNA, 20 bp, Artificial Sequence
  Description of Artificial Sequence: Synthetic oligonucleotide
  Target: FXN; (-) strand; PAM type: YTN; PAM sequence: TTC
acagtcaacatgctctcttt

SEQ ID NO: 27650 - DNA, 20 bp, Artificial Sequence
  Description of Artificial Sequence: Synthetic oligonucleotide
  Target: FXN; (-) strand; PAM type: YTN; PAM sequence: TTC
ccaattcacagtcaacatgc

SEQ ID NO: 27651 - DNA, 20 bp, Artificial Sequence
  Description of Artificial Sequence: Synthetic oligonucleotide
  Target: FXN; (-) strand; PAM type: YTN; PAM sequence: TTT
cccaattcacagtcaacatg

SEQ ID NO: 27652 - DNA, 20 bp, Artificial Sequence
  Description of Artificial Sequence: Synthetic oligonucleotide
  Target: FXN; (-) strand; PAM type: YTN; PAM sequence: CTT
tcccaattcacagtcaacat

SEQ ID NO: 27653 - DNA, 20 bp, Artificial Sequence
  Description of Artificial Sequence: Synthetic oligonucleotide
  Target: FXN; (-) strand; PAM type: YTN; PAM sequence: CTG
gccctttcccaattcacagt

SEQ ID NO: 27654 - DNA, 20 bp, Artificial Sequence
  Description of Artificial Sequence: Synthetic oligonucleotide
  Target: FXN; (-) strand; PAM type: YTN; PAM sequence: TTA
tctggccctttcccaattca

SEQ ID NO: 27655 - DNA, 20 bp, Artificial Sequence
  Description of Artificial Sequence: Synthetic oligonucleotide
  Target: FXN; (-) strand; PAM type: YTN; PAM sequence: TTT
atctggccctttcccaattc

SEQ ID NO: 27656 - DNA, 20 bp, Artificial Sequence
  Description of Artificial Sequence: Synthetic oligonucleotide
  Target: FXN; (-) strand; PAM type: YTN; PAM sequence: TTT
tatctggccctttcccaatt

SEQ ID NO: 27657 - DNA, 20 bp, Artificial Sequence
  Description of Artificial Sequence: Synthetic oligonucleotide
  Target: FXN; (-) strand; PAM type: YTN; PAM sequence: CTA
gttttatctggccctttccc

SEQ ID NO: 27658 - DNA, 20 bp, Artificial Sequence
  Description of Artificial Sequence: Synthetic oligonucleotide
  Target: FXN; (-) strand; PAM type: YTN; PAM sequence: CTA
tgctagttttatctggccct

SEQ ID NO: 27659 - DNA, 20 bp, Artificial Sequence
  Description of Artificial Sequence: Synthetic oligonucleotide
  Target: FXN; (-) strand; PAM type: YTN; PAM sequence: TTC
tatgctagttttatctggcc

SEQ ID NO: 27660 - DNA, 20 bp, Artificial Sequence
  Description of Artificial Sequence: Synthetic oligonucleotide
  Target: FXN; (-) strand; PAM type: YTN; PAM sequence: TTC
aaagaattctatgctagttt

SEQ ID NO: 27661 - DNA, 20 bp, Artificial Sequence
  Description of Artificial Sequence: Synthetic oligonucleotide
  Target: FXN; (-) strand; PAM type: YTN; PAM sequence: TTT
caaagaattctatgctagtt

SEQ ID NO: 27662 - DNA, 20 bp, Artificial Sequence
  Description of Artificial Sequence: Synthetic oligonucleotide
  Target: FXN; (-) strand; PAM type: YTN; PAM sequence: CTT
tcaaagaattctatgctagt

SEQ ID NO: 27663 - DNA, 20 bp, Artificial Sequence
  Description of Artificial Sequence: Synthetic oligonucleotide
  Target: FXN; (-) strand; PAM type: YTN; PAM sequence: TTA
gtctttcaaagaattctatg

SEQ ID NO: 27664 - DNA, 20 bp, Artificial Sequence
  Description of Artificial Sequence: Synthetic oligonucleotide
  Target: FXN; (-) strand; PAM type: YTN; PAM sequence: TTA
aaaaatgcaaataccgttag

SEQ ID NO: 27665 - DNA, 20 bp, Artificial Sequence
  Description of Artificial Sequence: Synthetic oligonucleotide
  Target: FXN; (-) strand; PAM type: YTN; PAM sequence: TTT
aaaaaatgcaaataccgtta

SEQ ID NO: 27666 - DNA, 20 bp, Artificial Sequence
  Description of Artificial Sequence: Synthetic oligonucleotide
  Target: FXN; (-) strand; PAM type: YTN; PAM sequence: TTT
taaaaaatgcaaataccgtt

SEQ ID NO: 27667 - DNA, 20 bp, Artificial Sequence
  Description of Artificial Sequence: Synthetic oligonucleotide
  Target: FXN; (-) strand; PAM type: YTN; PAM sequence: TTT
ttaaaaaatgcaaataccgt

SEQ ID NO: 27668 - DNA, 20 bp, Artificial Sequence
  Description of Artificial Sequence: Synthetic oligonucleotide
  Target: FXN; (-) strand; PAM type: YTN; PAM sequence: TTA
taatttttaaaaaatgcaaa

SEQ ID NO: 27669 - DNA, 20 bp, Artificial Sequence
  Description of Artificial Sequence: Synthetic oligonucleotide
  Target: FXN; (-) strand; PAM type: YTN; PAM sequence: TTA
gggggtagagtaaggttata

SEQ ID NO: 27670 - DNA, 20 bp, Artificial Sequence
  Description of Artificial Sequence: Synthetic oligonucleotide
  Target: FXN; (-) strand; PAM type: YTN; PAM sequence: CTA
aaaatgatgtcaatgttagg

SEQ ID NO: 27671 - DNA, 20 bp, Artificial Sequence
  Description of Artificial Sequence: Synthetic oligonucleotide
  Target: FXN; (-) strand; PAM type: YTN; PAM sequence: TTA
cctaaaaatgatgtcaatgt

SEQ ID NO: 27672 - DNA, 20 bp, Artificial Sequence
  Description of Artificial Sequence: Synthetic oligonucleotide
  Target: FXN; (-) strand; PAM type: YTN; PAM sequence: TTA
attacctaaaaatgatgtca

SEQ ID NO: 27673 - DNA, 20 bp, Artificial Sequence
  Description of Artificial Sequence: Synthetic oligonucleotide
  Target: FXN; (-) strand; PAM type: YTN; PAM sequence: TTA
gagatcacagaataataaat

SEQ ID NO: 27674 - DNA, 20 bp, Artificial Sequence
  Description of Artificial Sequence: Synthetic oligonucleotide
  Target: FXN; (-) strand; PAM type: YTN; PAM sequence: CTG
aacaaagcattagagatcac

SEQ ID NO: 27675 - DNA, 20 bp, Artificial Sequence
  Description of Artificial Sequence: Synthetic oligonucleotide
  Target: FXN; (-) strand; PAM type: YTN; PAM sequence: TTC
tgaacaaagcattagagatc

SEQ ID NO: 27676 - DNA, 20 bp, Artificial Sequence
  Description of Artificial Sequence: Synthetic oligonucleotide
  Target: FXN; (-) strand; PAM type: YTN; PAM sequence: TTA
ttctgaacaaagcattagag

SEQ ID NO: 27677 - DNA, 20 bp, Artificial Sequence
  Description of Artificial Sequence: Synthetic oligonucleotide
  Target: FXN; (-) strand; PAM type: YTN; PAM sequence: TTT
attctgaacaaagcattaga

SEQ ID NO: 27678 - DNA, 20 bp, Artificial Sequence
  Description of Artificial Sequence: Synthetic oligonucleotide
  Target: FXN; (-) strand; PAM type: YTN; PAM sequence: CTA
tttattctgaacaaagcatt

SEQ ID NO: 27679 - DNA, 20 bp, Artificial Sequence
  Description of Artificial Sequence: Synthetic oligonucleotide
  Target: FXN; (-) strand; PAM type: YTN; PAM sequence: TTG
gatgaaagtgtggggaaagg

SEQ ID NO: 27680 - DNA, 20 bp, Artificial Sequence
  Description of Artificial Sequence: Synthetic oligonucleotide
  Target: FXN; (-) strand; PAM type: YTN; PAM sequence: CTT
ggatgaaagtgtggggaaag

SEQ ID NO: 27681 - DNA, 20 bp, Artificial Sequence
  Description of Artificial Sequence: Synthetic oligonucleotide
  Target: FXN; (-) strand; PAM type: YTN; PAM sequence: TTC
ttggatgaaagtgtggggaa

SEQ ID NO: 27682 - DNA, 20 bp, Artificial Sequence
  Description of Artificial Sequence: Synthetic oligonucleotide
  Target: FXN; (-) strand; PAM type: YTN; PAM sequence: CTT
cttggatgaaagtgtgggga

SEQ ID NO: 27683 - DNA, 20 bp, Artificial Sequence
  Description of Artificial Sequence: Synthetic oligonucleotide
  Target: FXN; (-) strand; PAM type: YTN; PAM sequence: CTA
gcacacttcttggatgaaag

SEQ ID NO: 27684 - DNA, 20 bp, Artificial Sequence
  Description of Artificial Sequence: Synthetic oligonucleotide
  Target: FXN; (-) strand; PAM type: YTN; PAM sequence: CTC
tagcacacttcttggatgaa

SEQ ID NO: 27685 - DNA, 20 bp, Artificial Sequence
  Description of Artificial Sequence: Synthetic oligonucleotide
  Target: FXN; (-) strand; PAM type: YTN; PAM sequence: TTG
aactctagcacacttcttgg

SEQ ID NO: 27686 - DNA, 20 bp, Artificial Sequence
  Description of Artificial Sequence: Synthetic oligonucleotide
  Target: FXN; (-) strand; PAM type: YTN; PAM sequence: TTG
ttgaactctagcacacttct

SEQ ID NO: 27687 - DNA, 20 bp, Artificial Sequence
  Description of Artificial Sequence: Synthetic oligonucleotide
  Target: FXN; (-) strand; PAM type: YTN; PAM sequence: TTT
gttgaactctagcacacttc

SEQ ID NO: 27688 - DNA, 20 bp, Artificial Sequence
  Description of Artificial Sequence: Synthetic oligonucleotide
  Target: FXN; (-) strand; PAM type: YTN; PAM sequence: TTT
tgttgaactctagcacactt

SEQ ID NO: 27689 - DNA, 20 bp, Artificial Sequence
  Description of Artificial Sequence: Synthetic oligonucleotide
  Target: FXN; (-) strand; PAM type: YTN; PAM sequence: TTT
ttgttgaactctagcacact

SEQ ID NO: 27690 - DNA, 20 bp, Artificial Sequence
  Description of Artificial Sequence: Synthetic oligonucleotide
  Target: FXN; (-) strand; PAM type: YTN; PAM sequence: CTG
tttttgttgaactctagcac

SEQ ID NO: 27691 - DNA, 20 bp, Artificial Sequence
  Description of Artificial Sequence: Synthetic oligonucleotide
  Target: FXN; (-) strand; PAM type: YTN; PAM sequence: CTA
gtgctgtttttgttgaactc

SEQ ID NO: 27692 - DNA, 20 bp, Artificial Sequence
  Description of Artificial Sequence: Synthetic oligonucleotide
  Target: FXN; (-) strand; PAM type: YTN; PAM sequence: TTC
tagtgctgtttttgttgaac

SEQ ID NO: 27693 - DNA, 20 bp, Artificial Sequence
  Description of Artificial Sequence: Synthetic oligonucleotide
  Target: FXN; (-) strand; PAM type: YTN; PAM sequence: TTT
ctagtgctgtttttgttgaa

SEQ ID NO: 27694 - DNA, 20 bp, Artificial Sequence
  Description of Artificial Sequence: Synthetic oligonucleotide
  Target: FXN; (-) strand; PAM type: YTN; PAM sequence: CTA
gaatgacagtgatttctagt

SEQ ID NO: 27695 - DNA, 20 bp, Artificial Sequence
  Description of Artificial Sequence: Synthetic oligonucleotide
  Target: FXN; (-) strand; PAM type: YTN; PAM sequence: TTC
ctagaatgacagtgatttct

SEQ ID NO: 27696 - DNA, 20 bp, Artificial Sequence
  Description of Artificial Sequence: Synthetic oligonucleotide
  Target: FXN; (-) strand; PAM type: YTN; PAM sequence: CTT
cctagaatgacagtgatttc

SEQ ID NO: 27697 - DNA, 20 bp, Artificial Sequence
  Description of Artificial Sequence: Synthetic oligonucleotide
  Target: FXN; (-) strand; PAM type: YTN; PAM sequence: TTA
gggccttcctagaatgacag

SEQ ID NO: 27698 - DNA, 20 bp, Artificial Sequence
  Description of Artificial Sequence: Synthetic oligonucleotide
  Target: FXN; (-) strand; PAM type: YTN; PAM sequence: CTG
tgaattagggccttcctaga

SEQ ID NO: 27699 - DNA, 20 bp, Artificial Sequence
  Description of Artificial Sequence: Synthetic oligonucleotide
  Target: FXN; (-) strand; PAM type: YTN; PAM sequence: CTA
aaaaccaatacaatctgtga

SEQ ID NO: 27700 - DNA, 20 bp, Artificial Sequence
  Description of Artificial Sequence: Synthetic oligonucleotide
  Target: FXN; (-) strand; PAM type: YTN; PAM sequence: CTG
ggtctaaaaaccaatacaat

SEQ ID NO: 27701 - DNA, 20 bp, Artificial Sequence
  Description of Artificial Sequence: Synthetic oligonucleotide
  Target: FXN; (-) strand; PAM type: YTN; PAM sequence: CTA
actgggtctaaaaaccaata

SEQ ID NO: 27702 - DNA, 20 bp, Artificial Sequence
  Description of Artificial Sequence: Synthetic oligonucleotide
  Target: FXN; (-) strand; PAM type: YTN; PAM sequence: CTC
cagcacactaactgggtcta

SEQ ID NO: 27703 - DNA, 20 bp, Artificial Sequence
  Description of Artificial Sequence: Synthetic oligonucleotide
  Target: FXN; (-) strand; PAM type: YTN; PAM sequence: CTC
caacctccagcacactaact

SEQ ID NO: 27704 - DNA, 20 bp, Artificial Sequence
  Description of Artificial Sequence: Synthetic oligonucleotide
  Target: FXN; (-) strand; PAM type: YTN; PAM sequence: TTA
aaatcctccaacctccagca

SEQ ID NO: 27705 - DNA, 20 bp, Artificial Sequence
  Description of Artificial Sequence: Synthetic oligonucleotide
  Target: FXN; (-) strand; PAM type: YTN; PAM sequence: TTG
gcccacagaggttaaaatcc

SEQ ID NO: 27706 - DNA, 20 bp, Artificial Sequence
  Description of Artificial Sequence: Synthetic oligonucleotide
  Target: FXN; (-) strand; PAM type: YTN; PAM sequence: CTA
gttggcccacagaggttaaa

SEQ ID NO: 27707 - DNA, 20 bp, Artificial Sequence
  Description of Artificial Sequence: Synthetic oligonucleotide
  Target: FXN; (-) strand; PAM type: YTN; PAM sequence: CTG
aggccacagaggctagttgg

SEQ ID NO: 27708 - DNA, 20 bp, Artificial Sequence
  Description of Artificial Sequence: Synthetic oligonucleotide
  Target: FXN; (-) strand; PAM type: YTN; PAM sequence: CTC
aagcacagccagggtcagga

SEQ ID NO: 27709 - DNA, 20 bp, Artificial Sequence
  Description of Artificial Sequence: Synthetic oligonucleotide
  Target: FXN; (-) strand; PAM type: YTN; PAM sequence: TTC
ccccggagatgaaggataag

SEQ ID NO: 27710 - DNA, 20 bp, Artificial Sequence
  Description of Artificial Sequence: Synthetic oligonucleotide
  Target: FXN; (-) strand; PAM type: YTN; PAM sequence: TTC
gttcccccggagatgaagga

SEQ ID NO: 27711 - DNA, 20 bp, Artificial Sequence
  Description of Artificial Sequence: Synthetic oligonucleotide
  Target: FXN; (-) strand; PAM type: YTN; PAM sequence: CTT
cgttcccccggagatgaagg

SEQ ID NO: 27712 - DNA, 20 bp, Artificial Sequence
  Description of Artificial Sequence: Synthetic oligonucleotide
  Target: FXN; (-) strand; PAM type: YTN; PAM sequence: CTG
atccacttcgttcccccgga

SEQ ID NO: 27713 - DNA, 20 bp, Artificial Sequence
  Description of Artificial Sequence: Synthetic oligonucleotide
  Target: FXN; (-) strand; PAM type: YTN; PAM sequence: CTG
gaccgagctgatccacttcg

SEQ ID NO: 27714 - DNA, 20 bp, Artificial Sequence
  Description of Artificial Sequence: Synthetic oligonucleotide
  Target: FXN; (-) strand; PAM type: YTN; PAM sequence: CTG
atccccaaaagtgatcgctg

SEQ ID NO: 27715 - DNA, 20 bp, Artificial Sequence
  Description of Artificial Sequence: Synthetic oligonucleotide
  Target: FXN; (-) strand; PAM type: YTN; PAM sequence: CTA
caaagccactgatccccaaa

SEQ ID NO: 27716 - DNA, 20 bp, Artificial Sequence
  Description of Artificial Sequence: Synthetic oligonucleotide
  Target: FXN; (-) strand; PAM type: YTN; PAM sequence: CTG
cccgatatctacaaagccac

SEQ ID NO: 27717 - DNA, 20 bp, Artificial Sequence
  Description of Artificial Sequence: Synthetic oligonucleotide
  Target: FXN; (-) strand; PAM type: YTN; PAM sequence: TTG
gggtaagtgcctgcccgata

SEQ ID NO: 27718 - DNA, 20 bp, Artificial Sequence
  Description of Artificial Sequence: Synthetic oligonucleotide
  Target: FXN; (-) strand; PAM type: YTN; PAM sequence: TTT
ggggtaagtgcctgcccgat

SEQ ID NO: 27719 - DNA, 20 bp, Artificial Sequence
  Description of Artificial Sequence: Synthetic oligonucleotide
  Target: FXN; (-) strand; PAM type: YTN; PAM sequence: TTT
tggggtaagtgcctgcccga

SEQ ID NO: 27720 - DNA, 20 bp, Artificial Sequence
  Description of Artificial Sequence: Synthetic oligonucleotide
  Target: FXN; (-) strand; PAM type: YTN; PAM sequence: CTT
ttggggtaagtgcctgcccg

SEQ ID NO: 27721 - DNA, 20 bp, Artificial Sequence
  Description of Artificial Sequence: Synthetic oligonucleotide
  Target: FXN; (-) strand; PAM type: YTN; PAM sequence: TTC
ttttggggtaagtgcctgcc

SEQ ID NO: 27722 - DNA, 20 bp, Artificial Sequence
  Description of Artificial Sequence: Synthetic oligonucleotide
  Target: FXN; (-) strand; PAM type: YTN; PAM sequence: TTC
agatatggggaaagttcttt

SEQ ID NO: 27723 - DNA, 20 bp, Artificial Sequence
  Description of Artificial Sequence: Synthetic oligonucleotide
  Target: FXN; (-) strand; PAM type: YTN; PAM sequence: CTT
cagatatggggaaagttctt

SEQ ID NO: 27724 - DNA, 20 bp, Artificial Sequence
  Description of Artificial Sequence: Synthetic oligonucleotide
  Target: FXN; (-) strand; PAM type: YTN; PAM sequence: TTC
agtcttcagatatggggaaa

SEQ ID NO: 27725 - DNA, 20 bp, Artificial Sequence
  Description of Artificial Sequence: Synthetic oligonucleotide
  Target: FXN; (-) strand; PAM type: YTN; PAM sequence: TTT
cagtcttcagatatggggaa

SEQ ID NO: 27726 - DNA, 20 bp, Artificial Sequence
  Description of Artificial Sequence: Synthetic oligonucleotide
  Target: FXN; (-) strand; PAM type: YTN; PAM sequence: TTT
tcagtcttcagatatgggga

SEQ ID NO: 27727 - DNA, 20 bp, Artificial Sequence
  Description of Artificial Sequence: Synthetic oligonucleotide
  Target: FXN; (-) strand; PAM type: YTN; PAM sequence: CTG
ggcagtgtgtccaaatacga

SEQ ID NO: 27728 - DNA, 20 bp, Artificial Sequence
  Description of Artificial Sequence: Synthetic oligonucleotide
  Target: FXN; (-) strand; PAM type: YTN; PAM sequence: TTG
ctgggcagtgtgtccaaata

SEQ ID NO: 27729 - DNA, 20 bp, Artificial Sequence
  Description of Artificial Sequence: Synthetic oligonucleotide
  Target: FXN; (-) strand; PAM type: YTN; PAM sequence: CTA
gagcgtattgctgggcagtg

SEQ ID NO: 27730 - DNA, 20 bp, Artificial Sequence
  Description of Artificial Sequence: Synthetic oligonucleotide
  Target: FXN; (-) strand; PAM type: YTN; PAM sequence: CTG
aacacagctagagcgtattg

SEQ ID NO: 27731 - DNA, 20 bp, Artificial Sequence
  Description of Artificial Sequence: Synthetic oligonucleotide
  Target: FXN; (-) strand; PAM type: YTN; PAM sequence: TTC
tgaacacagctagagcgtat

SEQ ID NO: 27732 - DNA, 20 bp, Artificial Sequence
  Description of Artificial Sequence: Synthetic oligonucleotide
  Target: FXN; (-) strand; PAM type: YTN; PAM sequence: CTT
ctgaacacagctagagcgta

SEQ ID NO: 27733 - DNA, 20 bp, Artificial Sequence
  Description of Artificial Sequence: Synthetic oligonucleotide
  Target: FXN; (-) strand; PAM type: YTN; PAM sequence: TTC
ccatgcttctgaacacagct

SEQ ID NO: 27734 - DNA, 20 bp, Artificial Sequence
  Description of Artificial Sequence: Synthetic oligonucleotide
  Target: FXN; (-) strand; PAM type: YTN; PAM sequence: TTC
caaattcccatgcttctgaa

SEQ ID NO: 27735 - DNA, 20 bp, Artificial Sequence
  Description of Artificial Sequence: Synthetic oligonucleotide
  Target: FXN; (-) strand; PAM type: YTN; PAM sequence: TTT
ccaaattcccatgcttctga

SEQ ID NO: 27736 - DNA, 20 bp, Artificial Sequence
  Description of Artificial Sequence: Synthetic oligonucleotide
  Target: FXN; (-) strand; PAM type: YTN; PAM sequence: CTT
tccaaattcccatgcttctg

SEQ ID NO: 27737 - DNA, 20 bp, Artificial Sequence
  Description of Artificial Sequence: Synthetic oligonucleotide
  Target: FXN; (-) strand; PAM type: YTN; PAM sequence: CTC
agcagatctttccaaattcc

SEQ ID NO: 27738 - DNA, 20 bp, Artificial Sequence
  Description of Artificial Sequence: Synthetic oligonucleotide
  Target: FXN; (-) strand; PAM type: YTN; PAM sequence: CTG
tgacagtaaacggcatgctc

SEQ ID NO: 27739 - DNA, 20 bp, Artificial Sequence
  Description of Artificial Sequence: Synthetic oligonucleotide
  Target: FXN; (-) strand; PAM type: YTN; PAM sequence: TTG
aggaagatagtatctgtgac

SEQ ID NO: 27740 - DNA, 20 bp, Artificial Sequence
  Description of Artificial Sequence: Synthetic oligonucleotide
  Target: FXN; (-) strand; PAM type: YTN; PAM sequence: TTT
gaggaagatagtatctgtga

SEQ ID NO: 27741 - DNA, 20 bp, Artificial Sequence
  Description of Artificial Sequence: Synthetic oligonucleotide
  Target: FXN; (-) strand; PAM type: YTN; PAM sequence: TTT
tgaggaagatagtatctgtg

SEQ ID NO: 27742 - DNA, 20 bp, Artificial Sequence
  Description of Artificial Sequence: Synthetic oligonucleotide
  Target: FXN; (-) strand; PAM type: YTN; PAM sequence: TTT
ttgaggaagatagtatctgt

SEQ ID NO: 27743 - DNA, 20 bp, Artificial Sequence
  Description of Artificial Sequence: Synthetic oligonucleotide
  Target: FXN; (-) strand; PAM type: YTN; PAM sequence: TTT
tttgaggaagatagtatctg

SEQ ID NO: 27744 - DNA, 20 bp, Artificial Sequence
  Description of Artificial Sequence: Synthetic oligonucleotide
  Target: FXN; (-) strand; PAM type: YTN; PAM sequence: TTT
ttttgaggaagatagtatct

SEQ ID NO: 27745 - DNA, 20 bp, Artificial Sequence
  Description of Artificial Sequence: Synthetic oligonucleotide
  Target: FXN; (-) strand; PAM type: YTN; PAM sequence: TTT
tttttgaggaagatagtatc

SEQ ID NO: 27746 - DNA, 20 bp, Artificial Sequence
  Description of Artificial Sequence: Synthetic oligonucleotide
  Target: FXN; (-) strand; PAM type: YTN; PAM sequence: TTT
ttttttgaggaagatagtat

SEQ ID NO: 27747 - DNA, 20 bp, Artificial Sequence
  Description of Artificial Sequence: Synthetic oligonucleotide
  Target: FXN; (-) strand; PAM type: YTN; PAM sequence: TTT
tttttttgaggaagatagta

SEQ ID NO: 27748 - DNA, 20 bp, Artificial Sequence
  Description of Artificial Sequence: Synthetic oligonucleotide
  Target: FXN; (-) strand; PAM type: YTN; PAM sequence: TTT
ttttttttgaggaagatagt

SEQ ID NO: 27749 - DNA, 20 bp, Artificial Sequence
  Description of Artificial Sequence: Synthetic oligonucleotide
  Target: FXN; (-) strand; PAM type: YTN; PAM sequence: TTT
tttttttttgaggaagatag

SEQ ID NO: 27750 - DNA, 20 bp, Artificial Sequence
  Description of Artificial Sequence: Synthetic oligonucleotide
  Target: FXN; (-) strand; PAM type: YTN; PAM sequence: CTG
ccccgtcccccatatatata

SEQ ID NO: 27751 - DNA, 20 bp, Artificial Sequence
  Description of Artificial Sequence: Synthetic oligonucleotide
  Target: FXN; (-) strand; PAM type: YTN; PAM sequence: CTC
aacctgccccgtcccccata

SEQ ID NO: 27752 - DNA, 20 bp, Artificial Sequence
  Description of Artificial Sequence: Synthetic oligonucleotide
  Target: FXN; (-) strand; PAM type: YTN; PAM sequence: CTC
acccagtctcaacctgcccc

SEQ ID NO: 27753 - DNA, 20 bp, Artificial Sequence
  Description of Artificial Sequence: Synthetic oligonucleotide
  Target: FXN; (-) strand; PAM type: YTN; PAM sequence: TTC
agtctcacccagtctcaacc

SEQ ID NO: 27754 - DNA, 20 bp, Artificial Sequence
  Description of Artificial Sequence: Synthetic oligonucleotide
  Target: FXN; (-) strand; PAM type: YTN; PAM sequence: CTT
cagtctcacccagtctcaac

SEQ ID NO: 27755 - DNA, 20 bp, Artificial Sequence
  Description of Artificial Sequence: Synthetic oligonucleotide
  Target: FXN; (-) strand; PAM type: YTN; PAM sequence: CTC
ttcagtctcacccagtctca

SEQ ID NO: 27756 - DNA, 20 bp, Artificial Sequence
  Description of Artificial Sequence: Synthetic oligonucleotide
  Target: FXN; (-) strand; PAM type: YTN; PAM sequence: CTG
gccaaggcacctcttcagtc

SEQ ID NO: 27757 - DNA, 20 bp, Artificial Sequence
  Description of Artificial Sequence: Synthetic oligonucleotide
  Target: FXN; (-) strand; PAM type: YTN; PAM sequence: CTC
tggccaaggcacctcttcag

SEQ ID NO: 27758 - DNA, 20 bp, Artificial Sequence
  Description of Artificial Sequence: Synthetic oligonucleotide
  Target: FXN; (-) strand; PAM type: YTN; PAM sequence: CTG
ctctggccaaggcacctctt

SEQ ID NO: 27759 - DNA, 20 bp, Artificial Sequence
  Description of Artificial Sequence: Synthetic oligonucleotide
  Target: FXN; (-) strand; PAM type: YTN; PAM sequence: CTG
ggtgtggcctgctctggcca

SEQ ID NO: 27760 - DNA, 20 bp, Artificial Sequence
  Description of Artificial Sequence: Synthetic oligonucleotide
  Target: FXN; (-) strand; PAM type: YTN; PAM sequence: CTC
tgggtgtggcctgctctggc

SEQ ID NO: 27761 - DNA, 20 bp, Artificial Sequence
  Description of Artificial Sequence: Synthetic oligonucleotide
  Target: FXN; (-) strand; PAM type: YTN; PAM sequence: CTG
tggtctctgggtgtggcctg

SEQ ID NO: 27762 - DNA, 20 bp, Artificial Sequence
  Description of Artificial Sequence: Synthetic oligonucleotide
  Target: FXN; (-) strand; PAM type: YTN; PAM sequence: CTG
aggtggaccggggagcctgt

SEQ ID NO: 27763 - DNA, 20 bp, Artificial Sequence
  Description of Artificial Sequence: Synthetic oligonucleotide
  Target: FXN; (-) strand; PAM type: YTN; PAM sequence: CTG
ccggaaacggcgcaggaagg

SEQ ID NO: 27764 - DNA, 20 bp, Artificial Sequence
  Description of Artificial Sequence: Synthetic oligonucleotide
  Target: FXN; (-) strand; PAM type: YTN; PAM sequence: CTG
gatctgccggaaacggcgca

SEQ ID NO: 27765 - DNA, 20 bp, Artificial Sequence
  Description of Artificial Sequence: Synthetic oligonucleotide
  Target: FXN; (-) strand; PAM type: YTN; PAM sequence: CTC
tggatctgccggaaacggcg

SEQ ID NO: 27766 - DNA, 20 bp, Artificial Sequence
  Description of Artificial Sequence: Synthetic oligonucleotide
  Target: FXN; (-) strand; PAM type: YTN; PAM sequence: CTC
ccatccggcggtggccactc

SEQ ID NO: 27767 - DNA, 20 bp, Artificial Sequence
  Description of Artificial Sequence: Synthetic oligonucleotide
  Target: FXN; (-) strand; PAM type: YTN; PAM sequence: TTC
ccccgactcccatccggcgg

SEQ ID NO: 27768 - DNA, 20 bp, Artificial Sequence
  Description of Artificial Sequence: Synthetic oligonucleotide
  Target: FXN; (-) strand; PAM type: YTN; PAM sequence: CTT
cccccgactcccatccggcg

SEQ ID NO: 27769 - DNA, 20 bp, Artificial Sequence
  Description of Artificial Sequence: Synthetic oligonucleotide
  Target: FXN; (-) strand; PAM type: YTN; PAM sequence: CTC
ccttcccccgactcccatcc

SEQ ID NO: 27770 - DNA, 20 bp, Artificial Sequence
  Description of Artificial Sequence: Synthetic oligonucleotide
  Target: FXN; (-) strand; PAM type: YTN; PAM sequence: CTG
cctcccttcccccgactccc

SEQ ID NO: 27771 - DNA, 20 bp, Artificial Sequence
  Description of Artificial Sequence: Synthetic oligonucleotide
  Target: FXN; (-) strand; PAM type: YTN; PAM sequence: CTC
tgcctcccttcccccgactc

SEQ ID NO: 27772 - DNA, 20 bp, Artificial Sequence
  Description of Artificial Sequence: Synthetic oligonucleotide
  Target: FXN; (-) strand; PAM type: YTN; PAM sequence: TTC
tctgcctcccttcccccgac

SEQ ID NO: 27773 - DNA, 20 bp, Artificial Sequence
  Description of Artificial Sequence: Synthetic oligonucleotide
  Target: FXN; (-) strand; PAM type: YTN; PAM sequence: CTT
ctctgcctcccttcccccga

SEQ ID NO: 27774 - DNA, 20 bp, Artificial Sequence
  Description of Artificial Sequence: Synthetic oligonucleotide
  Target: FXN; (-) strand; PAM type: YTN; PAM sequence: CTC
agggcccgcttctctgcctc

SEQ ID NO: 27775 - DNA, 20 bp, Artificial Sequence
  Description of Artificial Sequence: Synthetic oligonucleotide
  Target: FXN; (-) strand; PAM type: YTN; PAM sequence: TTG
tcctcagggcccgcttctct

SEQ ID NO: 27776 - DNA, 20 bp, Artificial Sequence
  Description of Artificial Sequence: Synthetic oligonucleotide
  Target: FXN; (-) strand; PAM type: YTN; PAM sequence: CTT
gtcctcagggcccgcttctc

SEQ ID NO: 27777 - DNA, 20 bp, Artificial Sequence
  Description of Artificial Sequence: Synthetic oligonucleotide
  Target: FXN; (-) strand; PAM type: YTN; PAM sequence: CTG
agagcttgtcctcagggccc

SEQ ID NO: 27778 - DNA, 20 bp, Artificial Sequence
  Description of Artificial Sequence: Synthetic oligonucleotide
  Target: FXN; (-) strand; PAM type: YTN; PAM sequence: TTC
ccacagaagcactgagagct

SEQ ID NO: 27779 - DNA, 20 bp, Artificial Sequence
  Description of Artificial Sequence: Synthetic oligonucleotide
  Target: FXN; (-) strand; PAM type: YTN; PAM sequence: CTT
cccacagaagcactgagagc

SEQ ID NO: 27780 - DNA, 20 bp, Artificial Sequence
  Description of Artificial Sequence: Synthetic oligonucleotide
  Target: FXN; (-) strand; PAM type: YTN; PAM sequence: TTG
ccgccacttcccacagaagc

SEQ ID NO: 27781 - DNA, 20 bp, Artificial Sequence
  Description of Artificial Sequence: Synthetic oligonucleotide
  Target: FXN; (-) strand; PAM type: YTN; PAM sequence: CTT
gccgccacttcccacagaag

SEQ ID NO: 27782 - DNA, 20 bp, Artificial Sequence
  Description of Artificial Sequence: Synthetic oligonucleotide
  Target: FXN; (-) strand; PAM type: YTN; PAM sequence: CTG
ccgtcttgccgccacttccc

SEQ ID NO: 27783 - DNA, 20 bp, Artificial Sequence
  Description of Artificial Sequence: Synthetic oligonucleotide
  Target: FXN; (-) strand; PAM type: YTN; PAM sequence: CTG
ggagctgccgtcttgccgcc

SEQ ID NO: 27784 - DNA, 20 bp, Artificial Sequence
  Description of Artificial Sequence: Synthetic oligonucleotide
  Target: FXN; (-) strand; PAM type: YTN; PAM sequence: CTC
catcccccgctgggagctgc

SEQ ID NO: 27785 - DNA, 20 bp, Artificial Sequence
  Description of Artificial Sequence: Synthetic oligonucleotide
  Target: FXN; (-) strand; PAM type: YTN; PAM sequence: CTC
ggcctccatcccccgctggg

SEQ ID NO: 27786 - DNA, 20 bp, Artificial Sequence
  Description of Artificial Sequence: Synthetic oligonucleotide
  Target: FXN; (-) strand; PAM type: YTN; PAM sequence: CTG
actcggcctccatcccccgc

SEQ ID NO: 27787 - DNA, 20 bp, Artificial Sequence
  Description of Artificial Sequence: Synthetic oligonucleotide
  Target: FXN; (-) strand; PAM type: YTN; PAM sequence: CTC
cagtgaccagcagactgact

SEQ ID NO: 27788 - DNA, 20 bp, Artificial Sequence
  Description of Artificial Sequence: Synthetic oligonucleotide
  Target: FXN; (-) strand; PAM type: YTN; PAM sequence: CTG
gcctccagtgaccagcagac

SEQ ID NO: 27789 - DNA, 20 bp, Artificial Sequence
  Description of Artificial Sequence: Synthetic oligonucleotide
  Target: FXN; (-) strand; PAM type: YTN; PAM sequence: TTA
ggcagcatcctggcctccag

SEQ ID NO: 27790 - DNA, 20 bp, Artificial Sequence
  Description of Artificial Sequence: Synthetic oligonucleotide
  Target: FXN; (-) strand; PAM type: YTN; PAM sequence: CTG
tgttaggcagcatcctggcc

SEQ ID NO: 27791 - DNA, 20 bp, Artificial Sequence
  Description of Artificial Sequence: Synthetic oligonucleotide
  Target: FXN; (-) strand; PAM type: YTN; PAM sequence: CTG
gtggtgaggcccggagcggg

SEQ ID NO: 27792 - DNA, 20 bp, Artificial Sequence
  Description of Artificial Sequence: Synthetic oligonucleotide
  Target: FXN; (-) strand; PAM type: YTN; PAM sequence: CTG
tgtgggcagcaggccgggag

SEQ ID NO: 27793 - DNA, 20 bp, Artificial Sequence
  Description of Artificial Sequence: Synthetic oligonucleotide
  Target: FXN; (-) strand; PAM type: YTN; PAM sequence: CTC
ccccggaaccccgcagtctg

SEQ ID NO: 27794 - DNA, 20 bp, Artificial Sequence
  Description of Artificial Sequence: Synthetic oligonucleotide
  Target: FXN; (-) strand; PAM type: YTN; PAM sequence: CTG
ctcccccggaaccccgcagt

SEQ ID NO: 27795 - DNA, 20 bp, Artificial Sequence
  Description of Artificial Sequence: Synthetic oligonucleotide
  Target: FXN; (-) strand; PAM type: YTN; PAM sequence: CTG
ggtcctgctcccccggaacc

SEQ ID NO: 27796 - DNA, 20 bp, Artificial Sequence
  Description of Artificial Sequence: Synthetic oligonucleotide
  Target: FXN; (-) strand; PAM type: YTN; PAM sequence: TTC
caagaagacaggcgcagaac

SEQ ID NO: 27797 - DNA, 20 bp, Artificial Sequence
  Description of Artificial Sequence: Synthetic oligonucleotide
  Target: FXN; (-) strand; PAM type: YTN; PAM sequence: CTT
ccaagaagacaggcgcagaa

SEQ ID NO: 27798 - DNA, 20 bp, Artificial Sequence
  Description of Artificial Sequence: Synthetic oligonucleotide
  Target: FXN; (-) strand; PAM type: YTN; PAM sequence: CTC
cttccaagaagacaggcgca

SEQ ID NO: 27799 - DNA, 20 bp, Artificial Sequence
  Description of Artificial Sequence: Synthetic oligonucleotide
  Target: FXN; (-) strand; PAM type: YTN; PAM sequence: CTG
ctccttccaagaagacaggc

SEQ ID NO: 27800 - DNA, 20 bp, Artificial Sequence
  Description of Artificial Sequence: Synthetic oligonucleotide
  Target: FXN; (-) strand; PAM type: YTN; PAM sequence: CTC
cggcctgctccttccaagaa

SEQ ID NO: 27801 - DNA, 20 bp, Artificial Sequence
  Description of Artificial Sequence: Synthetic oligonucleotide
  Target: FXN; (-) strand; PAM type: YTN; PAM sequence: CTC
ccgcgctccggcctgctcct

SEQ ID NO: 27802 - DNA, 20 bp, Artificial Sequence
  Description of Artificial Sequence: Synthetic oligonucleotide
  Target: FXN; (-) strand; PAM type: YTN; PAM sequence: CTA
cacggcgctcccgcgctccg

SEQ ID NO: 27803 - DNA, 20 bp, Artificial Sequence
  Description of Artificial Sequence: Synthetic oligonucleotide
  Target: FXN; (-) strand; PAM type: YTN; PAM sequence: TTC
gcaggtacagctacacggcg

SEQ ID NO: 27804 - DNA, 20 bp, Artificial Sequence
  Description of Artificial Sequence: Synthetic oligonucleotide
  Target: FXN; (-) strand; PAM type: YTN; PAM sequence: CTT
cgcaggtacagctacacggc

SEQ ID NO: 27805 - DNA, 20 bp, Artificial Sequence
  Description of Artificial Sequence: Synthetic oligonucleotide
  Target: FXN; (-) strand; PAM type: YTN; PAM sequence: CTG
tgccttcgcaggtacagcta

SEQ ID NO: 27806 - DNA, 20 bp, Artificial Sequence
  Description of Artificial Sequence: Synthetic oligonucleotide
  Target: FXN; (-) strand; PAM type: YTN; PAM sequence: TTC
ccgcggaatcctgtgccttc

SEQ ID NO: 27807 - DNA, 20 bp, Artificial Sequence
  Description of Artificial Sequence: Synthetic oligonucleotide
  Target: FXN; (-) strand; PAM type: YTN; PAM sequence: CTT
cccgcggaatcctgtgcctt

SEQ ID NO: 27808 - DNA, 20 bp, Artificial Sequence
  Description of Artificial Sequence: Synthetic oligonucleotide
  Target: FXN; (-) strand; PAM type: YTN; PAM sequence: CTG
cgggatcttcccgcggaatc

SEQ ID NO: 27809 - DNA, 20 bp, Artificial Sequence
  Description of Artificial Sequence: Synthetic oligonucleotide
  Target: FXN; (-) strand; PAM type: YTN; PAM sequence: TTG
ccacaggtataaaaacaatg

SEQ ID NO: 27810 - DNA, 20 bp, Artificial Sequence
  Description of Artificial Sequence: Synthetic oligonucleotide
  Target: FXN; (-) strand; PAM type: YTN; PAM sequence: TTT
gccacaggtataaaaacaat

SEQ ID NO: 27811 - DNA, 20 bp, Artificial Sequence
  Description of Artificial Sequence: Synthetic oligonucleotide
  Target: FXN; (-) strand; PAM type: YTN; PAM sequence: CTG
gtcatgccatttgccacagg

SEQ ID NO: 27812 - DNA, 20 bp, Artificial Sequence
  Description of Artificial Sequence: Synthetic oligonucleotide
  Target: FXN; (-) strand; PAM type: YTN; PAM sequence: CTC
cagacataaccgtgtgtctg

SEQ ID NO: 27813 - DNA, 20 bp, Artificial Sequence
  Description of Artificial Sequence: Synthetic oligonucleotide
  Target: FXN; (-) strand; PAM type: YTN; PAM sequence: TTC
tccagacataaccgtgtgtc

SEQ ID NO: 27814 - DNA, 20 bp, Artificial Sequence
  Description of Artificial Sequence: Synthetic oligonucleotide
  Target: FXN; (-) strand; PAM type: YTN; PAM sequence: TTT
ctccagacataaccgtgtgt

SEQ ID NO: 27815 - DNA, 20 bp, Artificial Sequence
  Description of Artificial Sequence: Synthetic oligonucleotide
  Target: FXN; (-) strand; PAM type: YTN; PAM sequence: CTA
caggggtttctccagacata

SEQ ID NO: 27816 - DNA, 20 bp, Artificial Sequence
  Description of Artificial Sequence: Synthetic oligonucleotide
  Target: FXN; (-) strand; PAM type: YTN; PAM sequence: CTC
tacaggggtttctccagaca

SEQ ID NO: 27817 - DNA, 20 bp, Artificial Sequence
  Description of Artificial Sequence: Synthetic oligonucleotide
  Target: FXN; (-) strand; PAM type: YTN; PAM sequence: CTC
ctctacaggggtttctccag

SEQ ID NO: 27818 - DNA, 20 bp, Artificial Sequence
  Description of Artificial Sequence: Synthetic oligonucleotide
  Target: FXN; (-) strand; PAM type: YTN; PAM sequence: CTG
ctcctctacaggggtttctc

SEQ ID NO: 27819 - DNA, 20 bp, Artificial Sequence
  Description of Artificial Sequence: Synthetic oligonucleotide
  Target: FXN; (-) strand; PAM type: YTN; PAM sequence: CTC
ctgctcctctacaggggttt

SEQ ID NO: 27820 - DNA, 20 bp, Artificial Sequence
  Description of Artificial Sequence: Synthetic oligonucleotide
  Target: FXN; (-) strand; PAM type: YTN; PAM sequence: CTG
tccgggccacagcatgtcca

SEQ ID NO: 27821 - DNA, 20 bp, Artificial Sequence
  Description of Artificial Sequence: Synthetic oligonucleotide
  Target: FXN; (-) strand; PAM type: YTN; PAM sequence: CTC
ggcagccactgtccgggcca

SEQ ID NO: 27822 - DNA, 20 bp, Artificial Sequence
  Description of Artificial Sequence: Synthetic oligonucleotide
  Target: FXN; (-) strand; PAM type: YTN; PAM sequence: CTG
ctcggcagccactgtccggg

SEQ ID NO: 27823 - DNA, 20 bp, Artificial Sequence
  Description of Artificial Sequence: Synthetic oligonucleotide
  Target: FXN; (-) strand; PAM type: YTN; PAM sequence: CTC
caactgctcggcagccactg

SEQ ID NO: 27824 - DNA, 20 bp, Artificial Sequence
  Description of Artificial Sequence: Synthetic oligonucleotide
  Target: FXN; (-) strand; PAM type: YTN; PAM sequence: TTG
ggcgggtgcaggctccaact

SEQ ID NO: 27825 - DNA, 20 bp, Artificial Sequence
  Description of Artificial Sequence: Synthetic oligonucleotide
  Target: FXN; (-) strand; PAM type: YTN; PAM sequence: TTA
gccaagttgggcgggtgcag

SEQ ID NO: 27826 - DNA, 20 bp, Artificial Sequence
  Description of Artificial Sequence: Synthetic oligonucleotide
  Target: FXN; (-) strand; PAM type: YTN; PAM sequence: TTT
agccaagttgggcgggtgca

SEQ ID NO: 27827 - DNA, 20 bp, Artificial Sequence
  Description of Artificial Sequence: Synthetic oligonucleotide
  Target: FXN; (-) strand; PAM type: YTN; PAM sequence: CTT
tagccaagttgggcgggtgc

SEQ ID NO: 27828 - DNA, 20 bp, Artificial Sequence
  Description of Artificial Sequence: Synthetic oligonucleotide
  Target: FXN; (-) strand; PAM type: YTN; PAM sequence: TTC
tttagccaagttgggcgggt

SEQ ID NO: 27829 - DNA, 20 bp, Artificial Sequence
  Description of Artificial Sequence: Synthetic oligonucleotide
  Target: FXN; (-) strand; PAM type: YTN; PAM sequence: CTT
ctttagccaagttgggcggg

SEQ ID NO: 27830 - DNA, 20 bp, Artificial Sequence
  Description of Artificial Sequence: Synthetic oligonucleotide
  Target: FXN; (-) strand; PAM type: YTN; PAM sequence: TTC
cacagagagtatggggactt

SEQ ID NO: 27831 - DNA, 20 bp, Artificial Sequence
  Description of Artificial Sequence: Synthetic oligonucleotide
  Target: FXN; (-) strand; PAM type: YTN; PAM sequence: TTT
ccacagagagtatggggact

SEQ ID NO: 27832 - DNA, 20 bp, Artificial Sequence
  Description of Artificial Sequence: Synthetic oligonucleotide
  Target: FXN; (-) strand; PAM type: YTN; PAM sequence: TTT
tccacagagagtatggggac

SEQ ID NO: 27833 - DNA, 20 bp, Artificial Sequence
  Description of Artificial Sequence: Synthetic oligonucleotide
  Target: FXN; (-) strand; PAM type: YTN; PAM sequence: CTT
ttccacagagagtatgggga

SEQ ID NO: 27834 - DNA, 20 bp, Artificial Sequence
  Description of Artificial Sequence: Synthetic oligonucleotide
  Target: FXN; (-) strand; PAM type: YTN; PAM sequence: CTG
gaaatcttttccacagagag

SEQ ID NO: 27835 - DNA, 20 bp, Artificial Sequence
  Description of Artificial Sequence: Synthetic oligonucleotide
  Target: FXN; (-) strand; PAM type: YTN; PAM sequence: TTC
tggaaatcttttccacagag

SEQ ID NO: 27836 - DNA, 20 bp, Artificial Sequence
  Description of Artificial Sequence: Synthetic oligonucleotide
  Target: FXN; (-) strand; PAM type: YTN; PAM sequence: CTT
ctggaaatcttttccacaga

SEQ ID NO: 27837 - DNA, 20 bp, Artificial Sequence
  Description of Artificial Sequence: Synthetic oligonucleotide
  Target: FXN; (-) strand; PAM type: YTN; PAM sequence: TTG
acacaacagcttctggaaat

SEQ ID NO: 27838 - DNA, 20 bp, Artificial Sequence
  Description of Artificial Sequence: Synthetic oligonucleotide
  Target: FXN; (-) strand; PAM type: YTN; PAM sequence: TTG
atattgacacaacagcttct

SEQ ID NO: 27839 - DNA, 20 bp, Artificial Sequence
  Description of Artificial Sequence: Synthetic oligonucleotide
  Target: FXN; (-) strand; PAM type: YTN; PAM sequence: TTT
gatattgacacaacagcttc

SEQ ID NO: 27840 - DNA, 20 bp, Artificial Sequence
  Description of Artificial Sequence: Synthetic oligonucleotide
  Target: FXN; (-) strand; PAM type: YTN; PAM sequence: CTT
tgatattgacacaacagctt

SEQ ID NO: 27841 - DNA, 20 bp, Artificial Sequence
  Description of Artificial Sequence: Synthetic oligonucleotide
  Target: FXN; (-) strand; PAM type: YTN; PAM sequence: TTG
aggctttgatattgacacaa

SEQ ID NO: 27842 - DNA, 20 bp, Artificial Sequence
  Description of Artificial Sequence: Synthetic oligonucleotide
  Target: FXN; (-) strand; PAM type: YTN; PAM sequence: TTT
gaggctttgatattgacaca

SEQ ID NO: 27843 - DNA, 20 bp, Artificial Sequence
  Description of Artificial Sequence: Synthetic oligonucleotide
  Target: FXN; (-) strand; PAM type: YTN; PAM sequence: TTT
tgaggctttgatattgacac

SEQ ID NO: 27844 - DNA, 20 bp, Artificial Sequence
  Description of Artificial Sequence: Synthetic oligonucleotide
  Target: FXN; (-) strand; PAM type: YTN; PAM sequence: TTG
ttttgaggctttgatattga

SEQ ID NO: 27845 - DNA, 20 bp, Artificial Sequence
  Description of Artificial Sequence: Synthetic oligonucleotide
  Target: FXN; (-) strand; PAM type: YTN; PAM sequence: TTG
ttgttttgaggctttgatat

SEQ ID NO: 27846 - DNA, 20 bp, Artificial Sequence
  Description of Artificial Sequence: Synthetic oligonucleotide
  Target: FXN; (-) strand; PAM type: YTN; PAM sequence: TTG
ttgttgttttgaggctttga

SEQ ID NO: 27847 - DNA, 20 bp, Artificial Sequence
  Description of Artificial Sequence: Synthetic oligonucleotide
  Target: FXN; (-) strand; PAM type: YTN; PAM sequence: TTG
ttgttgttgttttgaggctt

SEQ ID NO: 27848 - DNA, 20 bp, Artificial Sequence
  Description of Artificial Sequence: Synthetic oligonucleotide
  Target: FXN; (-) strand; PAM type: YTN; PAM sequence: TTG
ttgttgttgttgttttgagg

SEQ ID NO: 27849 - DNA, 20 bp, Artificial Sequence
  Description of Artificial Sequence: Synthetic oligonucleotide
  Target: FXN; (-) strand; PAM type: YTN; PAM sequence: TTG
ttgttgttgttgttgttttg

SEQ ID NO: 27850 - DNA, 20 bp, Artificial Sequence
  Description of Artificial Sequence: Synthetic oligonucleotide
  Target: FXN; (-) strand; PAM type: YTN; PAM sequence: TTT
gttgttgttgttgttgtttt

SEQ ID NO: 27851 - DNA, 20 bp, Artificial Sequence
  Description of Artificial Sequence: Synthetic oligonucleotide
  Target: FXN; (-) strand; PAM type: YTN; PAM sequence: TTT
tgttgttgttgttgttgttt

SEQ ID NO: 27852 - DNA, 20 bp, Artificial Sequence
  Description of Artificial Sequence: Synthetic oligonucleotide
  Target: FXN; (-) strand; PAM type: YTN; PAM sequence: TTT
ttgttgttgttgttgttgtt

SEQ ID NO: 27853 - DNA, 20 bp, Artificial Sequence
  Description of Artificial Sequence: Synthetic oligonucleotide
  Target: FXN; (-) strand; PAM type: YTN; PAM sequence: TTC
atgtttttgttgttgttgtt

SEQ ID NO: 27854 - DNA, 20 bp, Artificial Sequence
  Description of Artificial Sequence: Synthetic oligonucleotide
  Target: FXN; (-) strand; PAM type: YTN; PAM sequence: TTT
catgtttttgttgttgttgt

SEQ ID NO: 27855 - DNA, 20 bp, Artificial Sequence
  Description of Artificial Sequence: Synthetic oligonucleotide
  Target: FXN; (-) strand; PAM type: YTN; PAM sequence: TTG
ataatttcatgtttttgttg

SEQ ID NO: 27856 - DNA, 20 bp, Artificial Sequence
  Description of Artificial Sequence: Synthetic oligonucleotide
  Target: FXN; (-) strand; PAM type: YTN; PAM sequence: TTG
ttgataatttcatgtttttg

SEQ ID NO: 27857 - DNA, 20 bp, Artificial Sequence
  Description of Artificial Sequence: Synthetic oligonucleotide
  Target: FXN; (-) strand; PAM type: YTN; PAM sequence: TTA
ttgttgataatttcatgttt

SEQ ID NO: 27858 - DNA, 20 bp, Artificial Sequence
  Description of Artificial Sequence: Synthetic oligonucleotide
  Target: FXN; (-) strand; PAM type: YTN; PAM sequence: TTT
attgttgataatttcatgtt

SEQ ID NO: 27859 - DNA, 20 bp, Artificial Sequence
  Description of Artificial Sequence: Synthetic oligonucleotide
  Target: FXN; (-) strand; PAM type: YTN; PAM sequence: CTT
tattgttgataatttcatgt

SEQ ID NO: 27860 - DNA, 20 bp, Artificial Sequence
  Description of Artificial Sequence: Synthetic oligonucleotide
  Target: FXN; (-) strand; PAM type: YTN; PAM sequence: CTC
aaggatgatctttattgttg

SEQ ID NO: 27861 - DNA, 20 bp, Artificial Sequence
  Description of Artificial Sequence: Synthetic oligonucleotide
  Target: FXN; (-) strand; PAM type: YTN; PAM sequence: TTC
aaagcagactcaaggatgat

SEQ ID NO: 27862 - DNA, 20 bp, Artificial Sequence
  Description of Artificial Sequence: Synthetic oligonucleotide
  Target: FXN; (-) strand; PAM type: YTN; PAM sequence: TTT
caaagcagactcaaggatga

SEQ ID NO: 27863 - DNA, 20 bp, Artificial Sequence
  Description of Artificial Sequence: Synthetic oligonucleotide
  Target: FXN; (-) strand; PAM type: YTN; PAM sequence: TTT
tcaaagcagactcaaggatg

SEQ ID NO: 27864 - DNA, 20 bp, Artificial Sequence
  Description of Artificial Sequence: Synthetic oligonucleotide
  Target: FXN; (-) strand; PAM type: YTN; PAM sequence: CTT
ttcaaagcagactcaaggat

SEQ ID NO: 27865 - DNA, 20 bp, Artificial Sequence
  Description of Artificial Sequence: Synthetic oligonucleotide
  Target: FXN; (-) strand; PAM type: YTN; PAM sequence: CTA
cttttcaaagcagactcaag

SEQ ID NO: 27866 - DNA, 20 bp, Artificial Sequence
  Description of Artificial Sequence: Synthetic oligonucleotide
  Target: FXN; (-) strand; PAM type: YTN; PAM sequence: TTC
accctacttttcaaagcaga

SEQ ID NO: 27867 - DNA, 20 bp, Artificial Sequence
  Description of Artificial Sequence: Synthetic oligonucleotide
  Target: FXN; (-) strand; PAM type: YTN; PAM sequence: TTT
caccctacttttcaaagcag

SEQ ID NO: 27868 - DNA, 20 bp, Artificial Sequence
  Description of Artificial Sequence: Synthetic oligonucleotide
  Target: FXN; (-) strand; PAM type: YTN; PAM sequence: CTG
cagaatttcaccctactttt

SEQ ID NO: 27869 - DNA, 20 bp, Artificial Sequence
  Description of Artificial Sequence: Synthetic oligonucleotide
  Target: FXN; (-) strand; PAM type: YTN; PAM sequence: CTC
tgcagaatttcaccctactt

SEQ ID NO: 27870 - DNA, 20 bp, Artificial Sequence
  Description of Artificial Sequence: Synthetic oligonucleotide
  Target: FXN; (-) strand; PAM type: YTN; PAM sequence: TTG
aatgcctctgcagaatttca

SEQ ID NO: 27871 - DNA, 20 bp, Artificial Sequence
  Description of Artificial Sequence: Synthetic oligonucleotide
  Target: FXN; (-) strand; PAM type: YTN; PAM sequence: TTG
ccagttgaatgcctctgcag

SEQ ID NO: 27872 - DNA, 20 bp, Artificial Sequence
  Description of Artificial Sequence: Synthetic oligonucleotide
  Target: FXN; (-) strand; PAM type: YTN; PAM sequence: CTT
gccagttgaatgcctctgca

SEQ ID NO: 27873 - DNA, 20 bp, Artificial Sequence
  Description of Artificial Sequence: Synthetic oligonucleotide
  Target: FXN; (-) strand; PAM type: YTN; PAM sequence: CTA
tgagggtggtatcttgccag

SEQ ID NO: 27874 - DNA, 20 bp, Artificial Sequence
  Description of Artificial Sequence: Synthetic oligonucleotide
  Target: FXN; (-) strand; PAM type: YTN; PAM sequence: CTG
gctatgagggtggtatcttg

SEQ ID NO: 27875 - DNA, 20 bp, Artificial Sequence
  Description of Artificial Sequence: Synthetic oligonucleotide
  Target: FXN; (-) strand; PAM type: YTN; PAM sequence: CTG
cagatctggctatgagggtg

SEQ ID NO: 27876 - DNA, 20 bp, Artificial Sequence
  Description of Artificial Sequence: Synthetic oligonucleotide
  Target: FXN; (-) strand; PAM type: YTN; PAM sequence: CTG
agacctgcagatctggctat

SEQ ID NO: 27877 - DNA, 20 bp, Artificial Sequence
  Description of Artificial Sequence: Synthetic oligonucleotide
  Target: FXN; (-) strand; PAM type: YTN; PAM sequence: CTG
gcatgatggctgagacctgc

SEQ ID NO: 27878 - DNA, 20 bp, Artificial Sequence
  Description of Artificial Sequence: Synthetic oligonucleotide
  Target: FXN; (-) strand; PAM type: YTN; PAM sequence: TTC
cctggcatgatggctgagac

SEQ ID NO: 27879 - DNA, 20 bp, Artificial Sequence
  Description of Artificial Sequence: Synthetic oligonucleotide
  Target: FXN; (-) strand; PAM type: YTN; PAM sequence: TTT
ccctggcatgatggctgaga

SEQ ID NO: 27880 - DNA, 20 bp, Artificial Sequence
  Description of Artificial Sequence: Synthetic oligonucleotide
  Target: FXN; (-) strand; PAM type: YTN; PAM sequence: TTT
tccctggcatgatggctgag

SEQ ID NO: 27881 - DNA, 20 bp, Artificial Sequence
  Description of Artificial Sequence: Synthetic oligonucleotide
  Target: FXN; (-) strand; PAM type: YTN; PAM sequence: CTG
aggagtggtgaatggagcat

SEQ ID NO: 27882 - DNA, 20 bp, Artificial Sequence
  Description of Artificial Sequence: Synthetic oligonucleotide
  Target: FXN; (-) strand; PAM type: YTN; PAM sequence: CTG
aaaccagaagcagaagctga

SEQ ID NO: 27883 - DNA, 20 bp, Artificial Sequence
  Description of Artificial Sequence: Synthetic oligonucleotide
  Target: FXN; (-) strand; PAM type: YTN; PAM sequence: CTC
tgaaaccagaagcagaagct

SEQ ID NO: 27884 - DNA, 20 bp, Artificial Sequence
  Description of Artificial Sequence: Synthetic oligonucleotide
  Target: FXN; (-) strand; PAM type: YTN; PAM sequence: CTC
caatacagagacctctgaaa

SEQ ID NO: 27885 - DNA, 20 bp, Artificial Sequence
  Description of Artificial Sequence: Synthetic oligonucleotide
  Target: FXN; (-) strand; PAM type: YTN; PAM sequence: TTA
aagcccctccaatacagaga

SEQ ID NO: 27886 - DNA, 20 bp, Artificial Sequence
  Description of Artificial Sequence: Synthetic oligonucleotide
  Target: FXN; (-) strand; PAM type: YTN; PAM sequence: TTT
aaagcccctccaatacagag

SEQ ID NO: 27887 - DNA, 20 bp, Artificial Sequence
  Description of Artificial Sequence: Synthetic oligonucleotide
  Target: FXN; (-) strand; PAM type: YTN; PAM sequence: CTT
taaagcccctccaatacaga

SEQ ID NO: 27888 - DNA, 20 bp, Artificial Sequence
  Description of Artificial Sequence: Synthetic oligonucleotide
  Target: FXN; (-) strand; PAM type: YTN; PAM sequence: TTG
ctttaaagcccctccaatac

SEQ ID NO: 27889 - DNA, 20 bp, Artificial Sequence
  Description of Artificial Sequence: Synthetic oligonucleotide
  Target: FXN; (-) strand; PAM type: YTN; PAM sequence: CTT
gctttaaagcccctccaata

SEQ ID NO: 27890 - DNA, 20 bp, Artificial Sequence
  Description of Artificial Sequence: Synthetic oligonucleotide
  Target: FXN; (-) strand; PAM type: YTN; PAM sequence: TTC
ttgctttaaagcccctccaa

SEQ ID NO: 27891 - DNA, 20 bp, Artificial Sequence
  Description of Artificial Sequence: Synthetic oligonucleotide
  Target: FXN; (-) strand; PAM type: YTN; PAM sequence: CTT
cttgctttaaagcccctcca

SEQ ID NO: 27892 - DNA, 20 bp, Artificial Sequence
  Description of Artificial Sequence: Synthetic oligonucleotide
  Target: FXN; (-) strand; PAM type: YTN; PAM sequence: CTG
tgaataagagtaagtgggta

SEQ ID NO: 27893 - DNA, 20 bp, Artificial Sequence
  Description of Artificial Sequence: Synthetic oligonucleotide
  Target: FXN; (-) strand; PAM type: YTN; PAM sequence: TTC
acatctgtgaataagagtaa

SEQ ID NO: 27894 - DNA, 20 bp, Artificial Sequence
  Description of Artificial Sequence: Synthetic oligonucleotide
  Target: FXN; (-) strand; PAM type: YTN; PAM sequence: CTG
catattcacatctgtgaata

SEQ ID NO: 27895 - DNA, 20 bp, Artificial Sequence
  Description of Artificial Sequence: Synthetic oligonucleotide
  Target: FXN; (-) strand; PAM type: YTN; PAM sequence: CTG
gacctgcatattcacatctg

SEQ ID NO: 27896 - DNA, 20 bp, Artificial Sequence
  Description of Artificial Sequence: Synthetic oligonucleotide
  Target: FXN; (-) strand; PAM type: YTN; PAM sequence: TTC
cccactggacctgcatattc

SEQ ID NO: 27897 - DNA, 20 bp, Artificial Sequence
  Description of Artificial Sequence: Synthetic oligonucleotide
  Target: FXN; (-) strand; PAM type: YTN; PAM sequence: TTT
ccccactggacctgcatatt

SEQ ID NO: 27898 - DNA, 20 bp, Artificial Sequence
  Description of Artificial Sequence: Synthetic oligonucleotide
  Target: FXN; (-) strand; PAM type: YTN; PAM sequence: CTT
tccccactggacctgcatat

SEQ ID NO: 27899 - DNA, 20 bp, Artificial Sequence
  Description of Artificial Sequence: Synthetic oligonucleotide
  Target: FXN; (-) strand; PAM type: YTN; PAM sequence: TTA
ggacatgtcactttccccac

SEQ ID NO: 27900 - DNA, 20 bp, Artificial Sequence
  Description of Artificial Sequence: Synthetic oligonucleotide
  Target: FXN; (-) strand; PAM type: YTN; PAM sequence: CTT
aggacatgtcactttcccca

SEQ ID NO: 27901 - DNA, 20 bp, Artificial Sequence
  Description of Artificial Sequence: Synthetic oligonucleotide
  Target: FXN; (-) strand; PAM type: YTN; PAM sequence: CTG
acttaggacatgtcactttc

SEQ ID NO: 27902 - DNA, 20 bp, Artificial Sequence
  Description of Artificial Sequence: Synthetic oligonucleotide
  Target: FXN; (-) strand; PAM type: YTN; PAM sequence: TTC
tgacttaggacatgtcactt

SEQ ID NO: 27903 - DNA, 20 bp, Artificial Sequence
  Description of Artificial Sequence: Synthetic oligonucleotide
  Target: FXN; (-) strand; PAM type: YTN; PAM sequence: CTA
ttctgacttaggacatgtca

SEQ ID NO: 27904 - DNA, 20 bp, Artificial Sequence
  Description of Artificial Sequence: Synthetic oligonucleotide
  Target: FXN; (-) strand; PAM type: YTN; PAM sequence: CTC
tattctgacttaggacatgt

SEQ ID NO: 27905 - DNA, 20 bp, Artificial Sequence
  Description of Artificial Sequence: Synthetic oligonucleotide
  Target: FXN; (-) strand; PAM type: YTN; PAM sequence: TTG
actctattctgacttaggac

SEQ ID NO: 27906 - DNA, 20 bp, Artificial Sequence
  Description of Artificial Sequence: Synthetic oligonucleotide
  Target: FXN; (-) strand; PAM type: YTN; PAM sequence: TTG
ttgactctattctgacttag

SEQ ID NO: 27907 - DNA, 20 bp, Artificial Sequence
  Description of Artificial Sequence: Synthetic oligonucleotide
  Target: FXN; (-) strand; PAM type: YTN; PAM sequence: CTT
gttgactctattctgactta

SEQ ID NO: 27908 - DNA, 20 bp, Artificial Sequence
  Description of Artificial Sequence: Synthetic oligonucleotide
  Target: FXN; (-) strand; PAM type: YTN; PAM sequence: TTC
ttgttgactctattctgact

SEQ ID NO: 27909 - DNA, 20 bp, Artificial Sequence
  Description of Artificial Sequence: Synthetic oligonucleotide
  Target: FXN; (-) strand; PAM type: YTN; PAM sequence: TTT
cttgttgactctattctgac

SEQ ID NO: 27910 - DNA, 20 bp, Artificial Sequence
  Description of Artificial Sequence: Synthetic oligonucleotide
  Target: FXN; (-) strand; PAM type: YTN; PAM sequence: TTT
tcttgttgactctattctga

SEQ ID NO: 27911 - DNA, 20 bp, Artificial Sequence
  Description of Artificial Sequence: Synthetic oligonucleotide
  Target: FXN; (-) strand; PAM type: YTN; PAM sequence: CTG
ttttcttgttgactctattc

SEQ ID NO: 27912 - DNA, 20 bp, Artificial Sequence
  Description of Artificial Sequence: Synthetic oligonucleotide
  Target: FXN; (-) strand; PAM type: YTN; PAM sequence: TTG
ggccctgttttcttgttgac

SEQ ID NO: 27913 - DNA, 20 bp, Artificial Sequence
  Description of Artificial Sequence: Synthetic oligonucleotide
  Target: FXN; (-) strand; PAM type: YTN; PAM sequence: TTT
gggccctgttttcttgttga

SEQ ID NO: 27914 - DNA, 20 bp, Artificial Sequence
  Description of Artificial Sequence: Synthetic oligonucleotide
  Target: FXN; (-) strand; PAM type: YTN; PAM sequence: TTT
tgggccctgttttcttgttg

SEQ ID NO: 27915 - DNA, 20 bp, Artificial Sequence
  Description of Artificial Sequence: Synthetic oligonucleotide
  Target: FXN; (-) strand; PAM type: YTN; PAM sequence: CTA
agtcattttgggccctgttt

SEQ ID NO: 27916 - DNA, 20 bp, Artificial Sequence
  Description of Artificial Sequence: Synthetic oligonucleotide
  Target: FXN; (-) strand; PAM type: YTN; PAM sequence: CTA
gaggctaagtcattttgggc

SEQ ID NO: 27917 - DNA, 20 bp, Artificial Sequence
  Description of Artificial Sequence: Synthetic oligonucleotide
  Target: FXN; (-) strand; PAM type: YTN; PAM sequence: TTA
tacactagaggctaagtcat

SEQ ID NO: 27918 - DNA, 20 bp, Artificial Sequence
  Description of Artificial Sequence: Synthetic oligonucleotide
  Target: FXN; (-) strand; PAM type: YTN; PAM sequence: CTC
atcaatgcccattatacact

SEQ ID NO: 27919 - DNA, 20 bp, Artificial Sequence
  Description of Artificial Sequence: Synthetic oligonucleotide
  Target: FXN; (-) strand; PAM type: YTN; PAM sequence: TTC
cagtagctcatcaatgccca

SEQ ID NO: 27920 - DNA, 20 bp, Artificial Sequence
  Description of Artificial Sequence: Synthetic oligonucleotide
  Target: FXN; (-) strand; PAM type: YTN; PAM sequence: TTT
ccagtagctcatcaatgccc

SEQ ID NO: 27921 - DNA, 20 bp, Artificial Sequence
  Description of Artificial Sequence: Synthetic oligonucleotide
  Target: FXN; (-) strand; PAM type: YTN; PAM sequence: CTG
tatttccagtagctcatcaa

SEQ ID NO: 27922 - DNA, 20 bp, Artificial Sequence
  Description of Artificial Sequence: Synthetic oligonucleotide
  Target: FXN; (-) strand; PAM type: YTN; PAM sequence: CTC
tgtatttccagtagctcatc

SEQ ID NO: 27923 - DNA, 20 bp, Artificial Sequence
  Description of Artificial Sequence: Synthetic oligonucleotide
  Target: FXN; (-) strand; PAM type: YTN; PAM sequence: TTC
atctctgtatttccagtagc

SEQ ID NO: 27924 - DNA, 20 bp, Artificial Sequence
  Description of Artificial Sequence: Synthetic oligonucleotide
  Target: FXN; (-) strand; PAM type: YTN; PAM sequence: CTT
catctctgtatttccagtag

SEQ ID NO: 27925 - DNA, 20 bp, Artificial Sequence
  Description of Artificial Sequence: Synthetic oligonucleotide
  Target: FXN; (-) strand; PAM type: YTN; PAM sequence: TTC
ttcatctctgtatttccagt

SEQ ID NO: 27926 - DNA, 20 bp, Artificial Sequence
  Description of Artificial Sequence: Synthetic oligonucleotide
  Target: FXN; (-) strand; PAM type: YTN; PAM sequence: TTT
cttcatctctgtatttccag

SEQ ID NO: 27927 - DNA, 20 bp, Artificial Sequence
  Description of Artificial Sequence: Synthetic oligonucleotide
  Target: FXN; (-) strand; PAM type: YTN; PAM sequence: TTT
tcttcatctctgtatttcca

SEQ ID NO: 27928 - DNA, 20 bp, Artificial Sequence
  Description of Artificial Sequence: Synthetic oligonucleotide
  Target: FXN; (-) strand; PAM type: YTN; PAM sequence: CTG
tgttttcttcatctctgtat

SEQ ID NO: 27929 - DNA, 20 bp, Artificial Sequence
  Description of Artificial Sequence: Synthetic oligonucleotide
  Target: FXN; (-) strand; PAM type: YTN; PAM sequence: TTG
aagatgggactgtgttttct

SEQ ID NO: 27930 - DNA, 20 bp, Artificial Sequence
  Description of Artificial Sequence: Synthetic oligonucleotide
  Target: FXN; (-) strand; PAM type: YTN; PAM sequence: CTT
gaagatgggactgtgttttc

SEQ ID NO: 27931 - DNA, 20 bp, Artificial Sequence
  Description of Artificial Sequence: Synthetic oligonucleotide
  Target: FXN; (-) strand; PAM type: YTN; PAM sequence: CTC
cttgaagatgggactgtgtt

SEQ ID NO: 27932 - DNA, 20 bp, Artificial Sequence
  Description of Artificial Sequence: Synthetic oligonucleotide
  Target: FXN; (-) strand; PAM type: YTN; PAM sequence: TTG
agctccttgaagatgggact

SEQ ID NO: 27933 - DNA, 20 bp, Artificial Sequence
  Description of Artificial Sequence: Synthetic oligonucleotide
  Target: FXN; (-) strand; PAM type: YTN; PAM sequence: CTA
gattgagctccttgaagatg

SEQ ID NO: 27934 - DNA, 20 bp, Artificial Sequence
  Description of Artificial Sequence: Synthetic oligonucleotide
  Target: FXN; (-) strand; PAM type: YTN; PAM sequence: TTG
ctagattgagctccttgaag

SEQ ID NO: 27935 - DNA, 20 bp, Artificial Sequence
  Description of Artificial Sequence: Synthetic oligonucleotide
  Target: FXN; (-) strand; PAM type: YTN; PAM sequence: CTT
gctagattgagctccttgaa

SEQ ID NO: 27936 - DNA, 20 bp, Artificial Sequence
  Description of Artificial Sequence: Synthetic oligonucleotide
  Target: FXN; (-) strand; PAM type: YTN; PAM sequence: CTC
ccttgctagattgagctcct

SEQ ID NO: 27937 - DNA, 20 bp, Artificial Sequence
  Description of Artificial Sequence: Synthetic oligonucleotide
  Target: FXN; (-) strand; PAM type: YTN; PAM sequence: CTG
tctcccttgctagattgagc

SEQ ID NO: 27938 - DNA, 20 bp, Artificial Sequence
  Description of Artificial Sequence: Synthetic oligonucleotide
  Target: FXN; (-) strand; PAM type: YTN; PAM sequence: CTA
caaagagtctgtctcccttg

SEQ ID NO: 27939 - DNA, 20 bp, Artificial Sequence
  Description of Artificial Sequence: Synthetic oligonucleotide
  Target: FXN; (-) strand; PAM type: YTN; PAM sequence: CTG
cagggaagcccggtcccacc

SEQ ID NO: 27940 - DNA, 20 bp, Artificial Sequence
  Description of Artificial Sequence: Synthetic oligonucleotide
  Target: FXN; (-) strand; PAM type: YTN; PAM sequence: CTG
ctgcagggaagcccggtccc

SEQ ID NO: 27941 - DNA, 20 bp, Artificial Sequence
  Description of Artificial Sequence: Synthetic oligonucleotide
  Target: FXN; (-) strand; PAM type: YTN; PAM sequence: TTC
tgctgcagggaagcccggtc

SEQ ID NO: 27942 - DNA, 20 bp, Artificial Sequence
  Description of Artificial Sequence: Synthetic oligonucleotide
  Target: FXN; (-) strand; PAM type: YTN; PAM sequence: CTT
ctgctgcagggaagcccggt

SEQ ID NO: 27943 - DNA, 20 bp, Artificial Sequence
  Description of Artificial Sequence: Synthetic oligonucleotide
  Target: FXN; (-) strand; PAM type: YTN; PAM sequence: TTC
cttctgctgcagggaagccc

SEQ ID NO: 27944 - DNA, 20 bp, Artificial Sequence
  Description of Artificial Sequence: Synthetic oligonucleotide
  Target: FXN; (-) strand; PAM type: YTN; PAM sequence: CTT
ccttctgctgcagggaagcc

SEQ ID NO: 27945 - DNA, 20 bp, Artificial Sequence
  Description of Artificial Sequence: Synthetic oligonucleotide
  Target: FXN; (-) strand; PAM type: YTN; PAM sequence: TTC
aagcttccttctgctgcagg

SEQ ID NO: 27946 - DNA, 20 bp, Artificial Sequence
  Description of Artificial Sequence: Synthetic oligonucleotide
  Target: FXN; (-) strand; PAM type: YTN; PAM sequence: TTT
caagcttccttctgctgcag

SEQ ID NO: 27947 - DNA, 20 bp, Artificial Sequence
  Description of Artificial Sequence: Synthetic oligonucleotide
  Target: FXN; (-) strand; PAM type: YTN; PAM sequence: TTA
ccaatttcaagcttccttct

SEQ ID NO: 27948 - DNA, 20 bp, Artificial Sequence
  Description of Artificial Sequence: Synthetic oligonucleotide
  Target: FXN; (-) strand; PAM type: YTN; PAM sequence: CTC
gttaccaatttcaagcttcc

SEQ ID NO: 27949 - DNA, 20 bp, Artificial Sequence
  Description of Artificial Sequence: Synthetic oligonucleotide
  Target: FXN; (-) strand; PAM type: YTN; PAM sequence: CTG
aggctcgttaccaatttcaa

SEQ ID NO: 27950 - DNA, 20 bp, Artificial Sequence
  Description of Artificial Sequence: Synthetic oligonucleotide
  Target: FXN; (-) strand; PAM type: YTN; PAM sequence: TTC
tgaggctcgttaccaatttc

SEQ ID NO: 27951 - DNA, 20 bp, Artificial Sequence
  Description of Artificial Sequence: Synthetic oligonucleotide
  Target: FXN; (-) strand; PAM type: YTN; PAM sequence: CTT
ctgaggctcgttaccaattt

SEQ ID NO: 27952 - DNA, 20 bp, Artificial Sequence
  Description of Artificial Sequence: Synthetic oligonucleotide
  Target: FXN; (-) strand; PAM type: YTN; PAM sequence: CTG
tcccttctgaggctcgttac

SEQ ID NO: 27953 - DNA, 20 bp, Artificial Sequence
  Description of Artificial Sequence: Synthetic oligonucleotide
  Target: FXN; (-) strand; PAM type: YTN; PAM sequence: CTC
tgtcccttctgaggctcgtt

SEQ ID NO: 27954 - DNA, 20 bp, Artificial Sequence
  Description of Artificial Sequence: Synthetic oligonucleotide
  Target: FXN; (-) strand; PAM type: YTN; PAM sequence: CTG
cctctgtcccttctgaggct

SEQ ID NO: 27955 - DNA, 20 bp, Artificial Sequence
  Description of Artificial Sequence: Synthetic oligonucleotide
  Target: FXN; (-) strand; PAM type: YTN; PAM sequence: CTC
agggtagcatggtggcctgc

SEQ ID NO: 27956 - DNA, 20 bp, Artificial Sequence
  Description of Artificial Sequence: Synthetic oligonucleotide
  Target: FXN; (-) strand; PAM type: YTN; PAM sequence: CTC
tcagggtagcatggtggcct

SEQ ID NO: 27957 - DNA, 20 bp, Artificial Sequence
  Description of Artificial Sequence: Synthetic oligonucleotide
  Target: FXN; (-) strand; PAM type: YTN; PAM sequence: CTA
gtgggtcaaagcagggccag

SEQ ID NO: 27958 - DNA, 20 bp, Artificial Sequence
  Description of Artificial Sequence: Synthetic oligonucleotide
  Target: FXN; (-) strand; PAM type: YTN; PAM sequence: CTA
cagcacagctagtgggtcaa

SEQ ID NO: 27959 - DNA, 20 bp, Artificial Sequence
  Description of Artificial Sequence: Synthetic oligonucleotide
  Target: FXN; (-) strand; PAM type: YTN; PAM sequence: CTG
gccctacagcacagctagtg

SEQ ID NO: 27960 - DNA, 20 bp, Artificial Sequence
  Description of Artificial Sequence: Synthetic oligonucleotide
  Target: FXN; (-) strand; PAM type: YTN; PAM sequence: CTC
cacctggccctacagcacag

SEQ ID NO: 27961 - DNA, 20 bp, Artificial Sequence
  Description of Artificial Sequence: Synthetic oligonucleotide
  Target: FXN; (-) strand; PAM type: YTN; PAM sequence: CTC
caggctccacctggccctac

SEQ ID NO: 27962 - DNA, 20 bp, Artificial Sequence
  Description of Artificial Sequence: Synthetic oligonucleotide
  Target: FXN; (-) strand; PAM type: YTN; PAM sequence: TTA
gcacaggccactccaggctc

SEQ ID NO: 27963 - DNA, 20 bp, Artificial Sequence
  Description of Artificial Sequence: Synthetic oligonucleotide
  Target: FXN; (-) strand; PAM type: YTN; PAM sequence: CTT
agcacaggccactccaggct

SEQ ID NO: 27964 - DNA, 20 bp, Artificial Sequence
  Description of Artificial Sequence: Synthetic oligonucleotide
  Target: FXN; (-) strand; PAM type: YTN; PAM sequence: CTC
atagtagccccttagcacag

SEQ ID NO: 27965 - DNA, 20 bp, Artificial Sequence
  Description of Artificial Sequence: Synthetic oligonucleotide
  Target: FXN; (-) strand; PAM type: YTN; PAM sequence: TTG
ggggagtggaaagagctcat

SEQ ID NO: 27966 - DNA, 20 bp, Artificial Sequence
  Description of Artificial Sequence: Synthetic oligonucleotide
  Target: FXN; (-) strand; PAM type: YTN; PAM sequence: CTT
gggggagtggaaagagctca

SEQ ID NO: 27967 - DNA, 20 bp, Artificial Sequence
  Description of Artificial Sequence: Synthetic oligonucleotide
  Target: FXN; (-) strand; PAM type: YTN; PAM sequence: TTA
tgcaatgccttgggggagtg

SEQ ID NO: 27968 - DNA, 20 bp, Artificial Sequence
  Description of Artificial Sequence: Synthetic oligonucleotide
  Target: FXN; (-) strand; PAM type: YTN; PAM sequence: TTT
atgcaatgccttgggggagt

SEQ ID NO: 27969 - DNA, 20 bp, Artificial Sequence
  Description of Artificial Sequence: Synthetic oligonucleotide
  Target: FXN; (-) strand; PAM type: YTN; PAM sequence: TTA
tttatgcaatgccttggggg

SEQ ID NO: 27970 - DNA, 20 bp, Artificial Sequence
  Description of Artificial Sequence: Synthetic oligonucleotide
  Target: FXN; (-) strand; PAM type: YTN; PAM sequence: CTG
tgcaaacagaaagtgacatt

SEQ ID NO: 27971 - DNA, 20 bp, Artificial Sequence
  Description of Artificial Sequence: Synthetic oligonucleotide
  Target: FXN; (-) strand; PAM type: YTN; PAM sequence: TTG
ctgtgcaaacagaaagtgac

SEQ ID NO: 27972 - DNA, 20 bp, Artificial Sequence
  Description of Artificial Sequence: Synthetic oligonucleotide
  Target: FXN; (-) strand; PAM type: YTN; PAM sequence: TTT
gctgtgcaaacagaaagtga

SEQ ID NO: 27973 - DNA, 20 bp, Artificial Sequence
  Description of Artificial Sequence: Synthetic oligonucleotide
  Target: FXN; (-) strand; PAM type: YTN; PAM sequence: TTT
tgctgtgcaaacagaaagtg

SEQ ID NO: 27974 - DNA, 20 bp, Artificial Sequence
  Description of Artificial Sequence: Synthetic oligonucleotide
  Target: FXN; (-) strand; PAM type: YTN; PAM sequence: CTG
attttgctgtgcaaacagaa

SEQ ID NO: 27975 - DNA, 20 bp, Artificial Sequence
  Description of Artificial Sequence: Synthetic oligonucleotide
  Target: FXN; (-) strand; PAM type: YTN; PAM sequence: TTG
tgtccctgattttgctgtgc

SEQ ID NO: 27976 - DNA, 20 bp, Artificial Sequence
  Description of Artificial Sequence: Synthetic oligonucleotide
  Target: FXN; (-) strand; PAM type: YTN; PAM sequence: CTA
gaaaattgtgtccctgattt

SEQ ID NO: 27977 - DNA, 20 bp, Artificial Sequence
  Description of Artificial Sequence: Synthetic oligonucleotide
  Target: FXN; (-) strand; PAM type: YTN; PAM sequence: TTC
tagaaaattgtgtccctgat

SEQ ID NO: 27978 - DNA, 20 bp, Artificial Sequence
  Description of Artificial Sequence: Synthetic oligonucleotide
  Target: FXN; (-) strand; PAM type: YTN; PAM sequence: CTG
gggggaggggaggcacccca

SEQ ID NO: 27979 - DNA, 20 bp, Artificial Sequence
  Description of Artificial Sequence: Synthetic oligonucleotide
  Target: FXN; (-) strand; PAM type: YTN; PAM sequence: TTG
ggctggggggaggggaggca

SEQ ID NO: 27980 - DNA, 20 bp, Artificial Sequence
  Description of Artificial Sequence: Synthetic oligonucleotide
  Target: FXN; (-) strand; PAM type: YTN; PAM sequence: CTG
ttgggctggggggaggggag

SEQ ID NO: 27981 - DNA, 20 bp, Artificial Sequence
  Description of Artificial Sequence: Synthetic oligonucleotide
  Target: FXN; (-) strand; PAM type: YTN; PAM sequence: TTC
tgttgggctggggggagggg

SEQ ID NO: 27982 - DNA, 20 bp, Artificial Sequence
  Description of Artificial Sequence: Synthetic oligonucleotide
  Target: FXN; (-) strand; PAM type: YTN; PAM sequence: CTT
ctgttgggctggggggaggg

SEQ ID NO: 27983 - DNA, 20 bp, Artificial Sequence
  Description of Artificial Sequence: Synthetic oligonucleotide
  Target: FXN; (-) strand; PAM type: YTN; PAM sequence: TTG
tagaacttctgttgggctgg

SEQ ID NO: 27984 - DNA, 20 bp, Artificial Sequence
  Description of Artificial Sequence: Synthetic oligonucleotide
  Target: FXN; (-) strand; PAM type: YTN; PAM sequence: CTC
aaacaaaaacaagggcccat

SEQ ID NO: 27985 - DNA, 20 bp, Artificial Sequence
  Description of Artificial Sequence: Synthetic oligonucleotide
  Target: FXN; (-) strand; PAM type: YTN; PAM sequence: TTC
cgtctcaaacaaaaacaagg

SEQ ID NO: 27986 - DNA, 20 bp, Artificial Sequence
  Description of Artificial Sequence: Synthetic oligonucleotide
  Target: FXN; (-) strand; PAM type: YTN; PAM sequence: CTG
tggggtgttccgtctcaaac

SEQ ID NO: 27987 - DNA, 20 bp, Artificial Sequence
  Description of Artificial Sequence: Synthetic oligonucleotide
  Target: FXN; (-) strand; PAM type: YTN; PAM sequence: CTC
ggaaccctgtggggtgttcc

SEQ ID NO: 27988 - DNA, 20 bp, Artificial Sequence
  Description of Artificial Sequence: Synthetic oligonucleotide
  Target: FXN; (-) strand; PAM type: YTN; PAM sequence: CTG
tgggccacaaatcaccactc

SEQ ID NO: 27989 - DNA, 20 bp, Artificial Sequence
  Description of Artificial Sequence: Synthetic oligonucleotide
  Target: FXN; (-) strand; PAM type: YTN; PAM sequence: TTG
ccagtggcctgtgggccaca

SEQ ID NO: 27990 - DNA, 20 bp, Artificial Sequence
  Description of Artificial Sequence: Synthetic oligonucleotide
  Target: FXN; (-) strand; PAM type: YTN; PAM sequence: CTT
gccagtggcctgtgggccac

SEQ ID NO: 27991 - DNA, 20 bp, Artificial Sequence
  Description of Artificial Sequence: Synthetic oligonucleotide
  Target: FXN; (-) strand; PAM type: YTN; PAM sequence: CTC
cacttgccagtggcctgtgg

SEQ ID NO: 27992 - DNA, 20 bp, Artificial Sequence
  Description of Artificial Sequence: Synthetic oligonucleotide
  Target: FXN; (-) strand; PAM type: YTN; PAM sequence: CTG
cctccacttgccagtggcct

SEQ ID NO: 27993 - DNA, 20 bp, Artificial Sequence
  Description of Artificial Sequence: Synthetic oligonucleotide
  Target: FXN; (-) strand; PAM type: YTN; PAM sequence: CTC
tgcctccacttgccagtggc

SEQ ID NO: 27994 - DNA, 20 bp, Artificial Sequence
  Description of Artificial Sequence: Synthetic oligonucleotide
  Target: FXN; (-) strand; PAM type: YTN; PAM sequence: CTG
cagctctgcctccacttgcc

SEQ ID NO: 27995 - DNA, 20 bp, Artificial Sequence
  Description of Artificial Sequence: Synthetic oligonucleotide
  Target: FXN; (-) strand; PAM type: YTN; PAM sequence: CTC
tgcagctctgcctccacttg

SEQ ID NO: 27996 - DNA, 20 bp, Artificial Sequence
  Description of Artificial Sequence: Synthetic oligonucleotide
  Target: FXN; (-) strand; PAM type: YTN; PAM sequence: CTC
ccgagggctctgcagctctg

SEQ ID NO: 27997 - DNA, 20 bp, Artificial Sequence
  Description of Artificial Sequence: Synthetic oligonucleotide
  Target: FXN; (-) strand; PAM type: YTN; PAM sequence: CTG
tggctcccgagggctctgca

SEQ ID NO: 27998 - DNA, 20 bp, Artificial Sequence
  Description of Artificial Sequence: Synthetic oligonucleotide
  Target: FXN; (-) strand; PAM type: YTN; PAM sequence: CTC
tgtggctcccgagggctctg

SEQ ID NO: 27999 - DNA, 20 bp, Artificial Sequence
  Description of Artificial Sequence: Synthetic oligonucleotide
  Target: FXN; (-) strand; PAM type: YTN; PAM sequence: TTG
gcatgtcgtggcggccagca

SEQ ID NO: 28000 - DNA, 20 bp, Artificial Sequence
  Description of Artificial Sequence: Synthetic oligonucleotide
  Target: FXN; (-) strand; PAM type: YTN; PAM sequence: CTG
agttggcatgtcgtggcggc

SEQ ID NO: 28001 - DNA, 20 bp, Artificial Sequence
  Description of Artificial Sequence: Synthetic oligonucleotide
  Target: FXN; (-) strand; PAM type: YTN; PAM sequence: CTG
ccgcccacaggagggccagc

SEQ ID NO: 28002 - DNA, 20 bp, Artificial Sequence
  Description of Artificial Sequence: Synthetic oligonucleotide
  Target: FXN; (-) strand; PAM type: YTN; PAM sequence: CTA
gcactgccgcccacaggagg

SEQ ID NO: 28003 - DNA, 20 bp, Artificial Sequence
  Description of Artificial Sequence: Synthetic oligonucleotide
  Target: FXN; (-) strand; PAM type: YTN; PAM sequence: CTG
cacatcactagcactgccgc

SEQ ID NO: 28004 - DNA, 20 bp, Artificial Sequence
  Description of Artificial Sequence: Synthetic oligonucleotide
  Target: FXN; (-) strand; PAM type: YTN; PAM sequence: TTC
tgcacatcactagcactgcc

SEQ ID NO: 28005 - DNA, 20 bp, Artificial Sequence
  Description of Artificial Sequence: Synthetic oligonucleotide
  Target: FXN; (-) strand; PAM type: YTN; PAM sequence: CTA
agattctgcacatcactagc

SEQ ID NO: 28006 - DNA, 20 bp, Artificial Sequence
  Description of Artificial Sequence: Synthetic oligonucleotide
  Target: FXN; (-) strand; PAM type: YTN; PAM sequence: CTA
gtcctaagattctgcacatc

SEQ ID NO: 28007 - DNA, 20 bp, Artificial Sequence
  Description of Artificial Sequence: Synthetic oligonucleotide
  Target: FXN; (-) strand; PAM type: YTN; PAM sequence: TTG
gcactagtcctaagattctg

SEQ ID NO: 28008 - DNA, 20 bp, Artificial Sequence
  Description of Artificial Sequence: Synthetic oligonucleotide
  Target: FXN; (-) strand; PAM type: YTN; PAM sequence: CTT
ggcactagtcctaagattct

SEQ ID NO: 28009 - DNA, 20 bp, Artificial Sequence
  Description of Artificial Sequence: Synthetic oligonucleotide
  Target: FXN; (-) strand; PAM type: YTN; PAM sequence: TTC
cttggcactagtcctaagat

SEQ ID NO: 28010 - DNA, 20 bp, Artificial Sequence
  Description of Artificial Sequence: Synthetic oligonucleotide
  Target: FXN; (-) strand; PAM type: YTN; PAM sequence: TTA
taggttccttggcactagtc

SEQ ID NO: 28011 - DNA, 20 bp, Artificial Sequence
  Description of Artificial Sequence: Synthetic oligonucleotide
  Target: FXN; (-) strand; PAM type: YTN; PAM sequence: TTT
ataggttccttggcactagt

SEQ ID NO: 28012 - DNA, 20 bp, Artificial Sequence
  Description of Artificial Sequence: Synthetic oligonucleotide
  Target: FXN; (-) strand; PAM type: YTN; PAM sequence: CTG
ggtcacccagggtatttata

SEQ ID NO: 28013 - DNA, 20 bp, Artificial Sequence
  Description of Artificial Sequence: Synthetic oligonucleotide
  Target: FXN; (-) strand; PAM type: YTN; PAM sequence: CTG
tgaaggccaccacagcagtg

SEQ ID NO: 28014 - DNA, 20 bp, Artificial Sequence
  Description of Artificial Sequence: Synthetic oligonucleotide
  Target: FXN; (-) strand; PAM type: YTN; PAM sequence: CTG
actgtgaaggccaccacagc

SEQ ID NO: 28015 - DNA, 20 bp, Artificial Sequence
  Description of Artificial Sequence: Synthetic oligonucleotide
  Target: FXN; (-) strand; PAM type: YTN; PAM sequence: TTC
tgactgtgaaggccaccaca

SEQ ID NO: 28016 - DNA, 20 bp, Artificial Sequence
  Description of Artificial Sequence: Synthetic oligonucleotide
  Target: FXN; (-) strand; PAM type: YTN; PAM sequence: CTT
ctgactgtgaaggccaccac

SEQ ID NO: 28017 - DNA, 20 bp, Artificial Sequence
  Description of Artificial Sequence: Synthetic oligonucleotide
  Target: FXN; (-) strand; PAM type: YTN; PAM sequence: TTG
tcatcttctgactgtgaagg

SEQ ID NO: 28018 - DNA, 20 bp, Artificial Sequence
  Description of Artificial Sequence: Synthetic oligonucleotide
  Target: FXN; (-) strand; PAM type: YTN; PAM sequence: CTT
gtcatcttctgactgtgaag

SEQ ID NO: 28019 - DNA, 20 bp, Artificial Sequence
  Description of Artificial Sequence: Synthetic oligonucleotide
  Target: FXN; (-) strand; PAM type: YTN; PAM sequence: CTC
agcttgtcatcttctgactg

SEQ ID NO: 28020 - DNA, 20 bp, Artificial Sequence
  Description of Artificial Sequence: Synthetic oligonucleotide
  Target: FXN; (-) strand; PAM type: YTN; PAM sequence: TTC
tcagcttgtcatcttctgac

SEQ ID NO: 28021 - DNA, 20 bp, Artificial Sequence
  Description of Artificial Sequence: Synthetic oligonucleotide
  Target: FXN; (-) strand; PAM type: YTN; PAM sequence: CTT
ctcagcttgtcatcttctga

SEQ ID NO: 28022 - DNA, 20 bp, Artificial Sequence
  Description of Artificial Sequence: Synthetic oligonucleotide
  Target: FXN; (-) strand; PAM type: YTN; PAM sequence: CTC
cccttctcagcttgtcatct

SEQ ID NO: 28023 - DNA, 20 bp, Artificial Sequence
  Description of Artificial Sequence: Synthetic oligonucleotide
  Target: FXN; (-) strand; PAM type: YTN; PAM sequence: TTC
tccccttctcagcttgtcat

SEQ ID NO: 28024 - DNA, 20 bp, Artificial Sequence
  Description of Artificial Sequence: Synthetic oligonucleotide
  Target: FXN; (-) strand; PAM type: YTN; PAM sequence: TTG
ggccgattctccccttctca

SEQ ID NO: 28025 - DNA, 20 bp, Artificial Sequence
  Description of Artificial Sequence: Synthetic oligonucleotide
  Target: FXN; (-) strand; PAM type: YTN; PAM sequence: CTT
gggccgattctccccttctc

SEQ ID NO: 28026 - DNA, 20 bp, Artificial Sequence
  Description of Artificial Sequence: Synthetic oligonucleotide
  Target: FXN; (-) strand; PAM type: YTN; PAM sequence: CTC
accttgggccgattctcccc

SEQ ID NO: 28027 - DNA, 20 bp, Artificial Sequence
  Description of Artificial Sequence: Synthetic oligonucleotide
  Target: FXN; (-) strand; PAM type: YTN; PAM sequence: CTG
tggatctcaccttgggccga

SEQ ID NO: 28028 - DNA, 20 bp, Artificial Sequence
  Description of Artificial Sequence: Synthetic oligonucleotide
  Target: FXN; (-) strand; PAM type: YTN; PAM sequence: TTC
tgtggatctcaccttgggcc

SEQ ID NO: 28029 - DNA, 20 bp, Artificial Sequence
  Description of Artificial Sequence: Synthetic oligonucleotide
  Target: FXN; (-) strand; PAM type: YTN; PAM sequence: TTT
ctgtggatctcaccttgggc

SEQ ID NO: 28030 - DNA, 20 bp, Artificial Sequence
  Description of Artificial Sequence: Synthetic oligonucleotide
  Target: FXN; (-) strand; PAM type: YTN; PAM sequence: CTT
tctgtggatctcaccttggg

SEQ ID NO: 28031 - DNA, 20 bp, Artificial Sequence
  Description of Artificial Sequence: Synthetic oligonucleotide
  Target: FXN; (-) strand; PAM type: YTN; PAM sequence: CTG
gcctttctgtggatctcacc

SEQ ID NO: 28032 - DNA, 20 bp, Artificial Sequence
  Description of Artificial Sequence: Synthetic oligonucleotide
  Target: FXN; (-) strand; PAM type: YTN; PAM sequence: TTG
gccctggcctttctgtggat

SEQ ID NO: 28033 - DNA, 20 bp, Artificial Sequence
  Description of Artificial Sequence: Synthetic oligonucleotide
  Target: FXN; (-) strand; PAM type: YTN; PAM sequence: CTT
ggccctggcctttctgtgga

SEQ ID NO: 28034 - DNA, 20 bp, Artificial Sequence
  Description of Artificial Sequence: Synthetic oligonucleotide
  Target: FXN; (-) strand; PAM type: YTN; PAM sequence: CTG
gccgcatcttggccctggcc

SEQ ID NO: 28035 - DNA, 20 bp, Artificial Sequence
  Description of Artificial Sequence: Synthetic oligonucleotide
  Target: FXN; (-) strand; PAM type: YTN; PAM sequence: CTG
aggtgctggccgcatcttgg

SEQ ID NO: 28036 - DNA, 20 bp, Artificial Sequence
  Description of Artificial Sequence: Synthetic oligonucleotide
  Target: FXN; (-) strand; PAM type: YTN; PAM sequence: CTG
gcatggtcaacgtaagacca

SEQ ID NO: 28037 - DNA, 20 bp, Artificial Sequence
  Description of Artificial Sequence: Synthetic oligonucleotide
  Target: FXN; (-) strand; PAM type: YTN; PAM sequence: CTC
tggcatggtcaacgtaagac

SEQ ID NO: 28038 - DNA, 20 bp, Artificial Sequence
  Description of Artificial Sequence: Synthetic oligonucleotide
  Target: FXN; (-) strand; PAM type: YTN; PAM sequence: CTG
gcctctggcatggtcaacgt

SEQ ID NO: 28039 - DNA, 20 bp, Artificial Sequence
  Description of Artificial Sequence: Synthetic oligonucleotide
  Target: FXN; (-) strand; PAM type: YTN; PAM sequence: TTG
gagcaatcaaggactggcct

SEQ ID NO: 28040 - DNA, 20 bp, Artificial Sequence
  Description of Artificial Sequence: Synthetic oligonucleotide
  Target: FXN; (-) strand; PAM type: YTN; PAM sequence: TTT
ggagcaatcaaggactggcc

SEQ ID NO: 28041 - DNA, 20 bp, Artificial Sequence
  Description of Artificial Sequence: Synthetic oligonucleotide
  Target: FXN; (-) strand; PAM type: YTN; PAM sequence: CTC
gaacagagggtttggagcaa

SEQ ID NO: 28042 - DNA, 20 bp, Artificial Sequence
  Description of Artificial Sequence: Synthetic oligonucleotide
  Target: FXN; (-) strand; PAM type: YTN; PAM sequence: TTG
gaaccctcgaacagagggtt

SEQ ID NO: 28043 - DNA, 20 bp, Artificial Sequence
  Description of Artificial Sequence: Synthetic oligonucleotide
  Target: FXN; (-) strand; PAM type: YTN; PAM sequence: TTT
ggaaccctcgaacagagggt

SEQ ID NO: 28044 - DNA, 20 bp, Artificial Sequence
  Description of Artificial Sequence: Synthetic oligonucleotide
  Target: FXN; (-) strand; PAM type: YTN; PAM sequence: TTC
atttggaaccctcgaacaga

SEQ ID NO: 28045 - DNA, 20 bp, Artificial Sequence
  Description of Artificial Sequence: Synthetic oligonucleotide
  Target: FXN; (-) strand; PAM type: YTN; PAM sequence: TTT
catttggaaccctcgaacag

SEQ ID NO: 28046 - DNA, 20 bp, Artificial Sequence
  Description of Artificial Sequence: Synthetic oligonucleotide
  Target: FXN; (-) strand; PAM type: YTN; PAM sequence: CTC
atttcatttggaaccctcga

SEQ ID NO: 28047 - DNA, 20 bp, Artificial Sequence
  Description of Artificial Sequence: Synthetic oligonucleotide
  Target: FXN; (-) strand; PAM type: YTN; PAM sequence: CTG
ctcatttcatttggaaccct

SEQ ID NO: 28048 - DNA, 20 bp, Artificial Sequence
  Description of Artificial Sequence: Synthetic oligonucleotide
  Target: FXN; (-) strand; PAM type: YTN; PAM sequence: CTG
acacgaggacctgctcattt

SEQ ID NO: 28049 - DNA, 20 bp, Artificial Sequence
  Description of Artificial Sequence: Synthetic oligonucleotide
  Target: FXN; (-) strand; PAM type: YTN; PAM sequence: CTA
ggtcctgacacgaggacctg

SEQ ID NO: 28050 - DNA, 20 bp, Artificial Sequence
  Description of Artificial Sequence: Synthetic oligonucleotide
  Target: FXN; (-) strand; PAM type: YTN; PAM sequence: CTA
acctaggtcctgacacgagg

SEQ ID NO: 28051 - DNA, 20 bp, Artificial Sequence
  Description of Artificial Sequence: Synthetic oligonucleotide
  Target: FXN; (-) strand; PAM type: YTN; PAM sequence: TTC
agaaactaacctaggtcctg

SEQ ID NO: 28052 - DNA, 20 bp, Artificial Sequence
  Description of Artificial Sequence: Synthetic oligonucleotide
  Target: FXN; (-) strand; PAM type: YTN; PAM sequence: TTT
cagaaactaacctaggtcct

SEQ ID NO: 28053 - DNA, 20 bp, Artificial Sequence
  Description of Artificial Sequence: Synthetic oligonucleotide
  Target: FXN; (-) strand; PAM type: YTN; PAM sequence: TTT
tcagaaactaacctaggtcc

SEQ ID NO: 28054 - DNA, 20 bp, Artificial Sequence
  Description of Artificial Sequence: Synthetic oligonucleotide
  Target: FXN; (-) strand; PAM type: YTN; PAM sequence: TTT
ttcagaaactaacctaggtc

SEQ ID NO: 28055 - DNA, 20 bp, Artificial Sequence
  Description of Artificial Sequence: Synthetic oligonucleotide
  Target: FXN; (-) strand; PAM type: YTN; PAM sequence: CTT
tttcagaaactaacctaggt

SEQ ID NO: 28056 - DNA, 20 bp, Artificial Sequence
  Description of Artificial Sequence: Synthetic oligonucleotide
  Target: FXN; (-) strand; PAM type: YTN; PAM sequence: TTC
atgctttttcagaaactaac

SEQ ID NO: 28057 - DNA, 20 bp, Artificial Sequence
  Description of Artificial Sequence: Synthetic oligonucleotide
  Target: FXN; (-) strand; PAM type: YTN; PAM sequence: TTT
catgctttttcagaaactaa

SEQ ID NO: 28058 - DNA, 20 bp, Artificial Sequence
  Description of Artificial Sequence: Synthetic oligonucleotide
  Target: FXN; (-) strand; PAM type: YTN; PAM sequence: TTT
tcatgctttttcagaaacta

SEQ ID NO: 28059 - DNA, 20 bp, Artificial Sequence
  Description of Artificial Sequence: Synthetic oligonucleotide
  Target: FXN; (-) strand; PAM type: YTN; PAM sequence: CTT
ttcatgctttttcagaaact

SEQ ID NO: 28060 - DNA, 20 bp, Artificial Sequence
  Description of Artificial Sequence: Synthetic oligonucleotide
  Target: FXN; (-) strand; PAM type: YTN; PAM sequence: CTG
cttttcatgctttttcagaa

SEQ ID NO: 28061 - DNA, 20 bp, Artificial Sequence
  Description of Artificial Sequence: Synthetic oligonucleotide
  Target: FXN; (-) strand; PAM type: YTN; PAM sequence: TTC
aggaggcctgcttttcatgc

SEQ ID NO: 28062 - DNA, 20 bp, Artificial Sequence
  Description of Artificial Sequence: Synthetic oligonucleotide
  Target: FXN; (-) strand; PAM type: YTN; PAM sequence: CTC
ggggaagttcaggaggcctg

SEQ ID NO: 28063 - DNA, 20 bp, Artificial Sequence
  Description of Artificial Sequence: Synthetic oligonucleotide
  Target: FXN; (-) strand; PAM type: YTN; PAM sequence: TTG
catcagtcactcggggaagt

SEQ ID NO: 28064 - DNA, 20 bp, Artificial Sequence
  Description of Artificial Sequence: Synthetic oligonucleotide
  Target: FXN; (-) strand; PAM type: YTN; PAM sequence: TTT
gcatcagtcactcggggaag

SEQ ID NO: 28065 - DNA, 20 bp, Artificial Sequence
  Description of Artificial Sequence: Synthetic oligonucleotide
  Target: FXN; (-) strand; PAM type: YTN; PAM sequence: CTT
tgcatcagtcactcggggaa

SEQ ID NO: 28066 - DNA, 20 bp, Artificial Sequence
  Description of Artificial Sequence: Synthetic oligonucleotide
  Target: FXN; (-) strand; PAM type: YTN; PAM sequence: CTG
tgaagcatgcaggacgcact

SEQ ID NO: 28067 - DNA, 20 bp, Artificial Sequence
  Description of Artificial Sequence: Synthetic oligonucleotide
  Target: FXN; (-) strand; PAM type: YTN; PAM sequence: CTC
catggtgctgtgaagcatgc

SEQ ID NO: 28068 - DNA, 20 bp, Artificial Sequence
  Description of Artificial Sequence: Synthetic oligonucleotide
  Target: FXN; (-) strand; PAM type: YTN; PAM sequence: CTC
tccatggtgctgtgaagcat

SEQ ID NO: 28069 - DNA, 20 bp, Artificial Sequence
  Description of Artificial Sequence: Synthetic oligonucleotide
  Target: FXN; (-) strand; PAM type: YTN; PAM sequence: CTG
aagatcctctccatggtgct

SEQ ID NO: 28070 - DNA, 20 bp, Artificial Sequence
  Description of Artificial Sequence: Synthetic oligonucleotide
  Target: FXN; (-) strand; PAM type: YTN; PAM sequence: TTG
cccctgaagatcctctccat

SEQ ID NO: 28071 - DNA, 20 bp, Artificial Sequence
  Description of Artificial Sequence: Synthetic oligonucleotide
  Target: FXN; (-) strand; PAM type: YTN; PAM sequence: TTT
gcccctgaagatcctctcca

SEQ ID NO: 28072 - DNA, 20 bp, Artificial Sequence
  Description of Artificial Sequence: Synthetic oligonucleotide
  Target: FXN; (-) strand; PAM type: YTN; PAM sequence: CTG
cagtttgcccctgaagatcc

SEQ ID NO: 28073 - DNA, 20 bp, Artificial Sequence
  Description of Artificial Sequence: Synthetic oligonucleotide
  Target: FXN; (-) strand; PAM type: YTN; PAM sequence: TTC
agatagtctgcagtttgccc

SEQ ID NO: 28074 - DNA, 20 bp, Artificial Sequence
  Description of Artificial Sequence: Synthetic oligonucleotide
  Target: FXN; (-) strand; PAM type: YTN; PAM sequence: CTG
atggtcagtgccgtcattca

SEQ ID NO: 28075 - DNA, 20 bp, Artificial Sequence
  Description of Artificial Sequence: Synthetic oligonucleotide
  Target: FXN; (-) strand; PAM type: YTN; PAM sequence: TTG
ctgatggtcagtgccgtcat

SEQ ID NO: 28076 - DNA, 20 bp, Artificial Sequence
  Description of Artificial Sequence: Synthetic oligonucleotide
  Target: FXN; (-) strand; PAM type: YTN; PAM sequence: TTT
gctgatggtcagtgccgtca

SEQ ID NO: 28077 - DNA, 20 bp, Artificial Sequence
  Description of Artificial Sequence: Synthetic oligonucleotide
  Target: FXN; (-) strand; PAM type: YTN; PAM sequence: CTG
cggtttgctgatggtcagtg

SEQ ID NO: 28078 - DNA, 20 bp, Artificial Sequence
  Description of Artificial Sequence: Synthetic oligonucleotide
  Target: FXN; (-) strand; PAM type: YTN; PAM sequence: CTC
tgcggtttgctgatggtcag

SEQ ID NO: 28079 - DNA, 20 bp, Artificial Sequence
  Description of Artificial Sequence: Synthetic oligonucleotide
  Target: FXN; (-) strand; PAM type: YTN; PAM sequence: TTG
gtcaggcagctctgcggttt

SEQ ID NO: 28080 - DNA, 20 bp, Artificial Sequence
  Description of Artificial Sequence: Synthetic oligonucleotide
  Target: FXN; (-) strand; PAM type: YTN; PAM sequence: CTT
ggtcaggcagctctgcggtt

SEQ ID NO: 28081 - DNA, 20 bp, Artificial Sequence
  Description of Artificial Sequence: Synthetic oligonucleotide
  Target: FXN; (-) strand; PAM type: YTN; PAM sequence: TTC
ttggtcaggcagctctgcgg

SEQ ID NO: 28082 - DNA, 20 bp, Artificial Sequence
  Description of Artificial Sequence: Synthetic oligonucleotide
  Target: FXN; (-) strand; PAM type: YTN; PAM sequence: TTT
cttggtcaggcagctctgcg

SEQ ID NO: 28083 - DNA, 20 bp, Artificial Sequence
  Description of Artificial Sequence: Synthetic oligonucleotide
  Target: FXN; (-) strand; PAM type: YTN; PAM sequence: CTC
gcaatttcttggtcaggcag

SEQ ID NO: 28084 - DNA, 20 bp, Artificial Sequence
  Description of Artificial Sequence: Synthetic oligonucleotide
  Target: FXN; (-) strand; PAM type: YTN; PAM sequence: CTG
tctcgcaatttcttggtcag

SEQ ID NO: 28085 - DNA, 20 bp, Artificial Sequence
  Description of Artificial Sequence: Synthetic oligonucleotide
  Target: FXN; (-) strand; PAM type: YTN; PAM sequence: TTC
tgtctcgcaatttcttggtc

SEQ ID NO: 28086 - DNA, 20 bp, Artificial Sequence
  Description of Artificial Sequence: Synthetic oligonucleotide
  Target: FXN; (-) strand; PAM type: YTN; PAM sequence: CTT
ctgtctcgcaatttcttggt

SEQ ID NO: 28087 - DNA, 20 bp, Artificial Sequence
  Description of Artificial Sequence: Synthetic oligonucleotide
  Target: FXN; (-) strand; PAM type: YTN; PAM sequence: TTG
cttctgtctcgcaatttctt

SEQ ID NO: 28088 - DNA, 20 bp, Artificial Sequence
  Description of Artificial Sequence: Synthetic oligonucleotide
  Target: FXN; (-) strand; PAM type: YTN; PAM sequence: CTG
caagcattgcttctgtctcg

SEQ ID NO: 28089 - DNA, 20 bp, Artificial Sequence
  Description of Artificial Sequence: Synthetic oligonucleotide
  Target: FXN; (-) strand; PAM type: YTN; PAM sequence: TTC
gcctgcaagcattgcttctg

SEQ ID NO: 28090 - DNA, 20 bp, Artificial Sequence
  Description of Artificial Sequence: Synthetic oligonucleotide
  Target: FXN; (-) strand; PAM type: YTN; PAM sequence: CTT
cgcctgcaagcattgcttct

SEQ ID NO: 28091 - DNA, 20 bp, Artificial Sequence
  Description of Artificial Sequence: Synthetic oligonucleotide
  Target: FXN; (-) strand; PAM type: YTN; PAM sequence: TTC
ttcgcctgcaagcattgctt

SEQ ID NO: 28092 - DNA, 20 bp, Artificial Sequence
  Description of Artificial Sequence: Synthetic oligonucleotide
  Target: FXN; (-) strand; PAM type: YTN; PAM sequence: CTT
cttcgcctgcaagcattgct

SEQ ID NO: 28093 - DNA, 20 bp, Artificial Sequence
  Description of Artificial Sequence: Synthetic oligonucleotide
  Target: FXN; (-) strand; PAM type: YTN; PAM sequence: TTC
ttcttcgcctgcaagcattg

SEQ ID NO: 28094 - DNA, 20 bp, Artificial Sequence
  Description of Artificial Sequence: Synthetic oligonucleotide
  Target: FXN; (-) strand; PAM type: YTN; PAM sequence: CTT
cttcttcgcctgcaagcatt

SEQ ID NO: 28095 - DNA, 20 bp, Artificial Sequence
  Description of Artificial Sequence: Synthetic oligonucleotide
  Target: FXN; (-) strand; PAM type: YTN; PAM sequence: CTG
gccccttcttcttcgcctgc

SEQ ID NO: 28096 - DNA, 20 bp, Artificial Sequence
  Description of Artificial Sequence: Synthetic oligonucleotide
  Target: FXN; (-) strand; PAM type: YTN; PAM sequence: CTG
tgtctggccccttcttcttc

SEQ ID NO: 28097 - DNA, 20 bp, Artificial Sequence
  Description of Artificial Sequence: Synthetic oligonucleotide
  Target: FXN; (-) strand; PAM type: YTN; PAM sequence: TTA
caggcgtgagccactgtgtc

SEQ ID NO: 28098 - DNA, 20 bp, Artificial Sequence
  Description of Artificial Sequence: Synthetic oligonucleotide
  Target: FXN; (-) strand; PAM type: YTN; PAM sequence: CTG
ggattacaggcgtgagccac

SEQ ID NO: 28099 - DNA, 20 bp, Artificial Sequence
  Description of Artificial Sequence: Synthetic oligonucleotide
  Target: FXN; (-) strand; PAM type: YTN; PAM sequence: CTC
ccaaagtgctgggattacag

SEQ ID NO: 28100 - DNA, 20 bp, Artificial Sequence
  Description of Artificial Sequence: Synthetic oligonucleotide
  Target: FXN; (-) strand; PAM type: YTN; PAM sequence: TTG
gcctcccaaagtgctgggat

SEQ ID NO: 28101 - DNA, 20 bp, Artificial Sequence
  Description of Artificial Sequence: Synthetic oligonucleotide
  Target: FXN; (-) strand; PAM type: YTN; PAM sequence: CTT
ggcctcccaaagtgctggga

SEQ ID NO: 28102 - DNA, 20 bp, Artificial Sequence
  Description of Artificial Sequence: Synthetic oligonucleotide
  Target: FXN; (-) strand; PAM type: YTN; PAM sequence: CTG
ccttggcctcccaaagtgct

SEQ ID NO: 28103 - DNA, 20 bp, Artificial Sequence
  Description of Artificial Sequence: Synthetic oligonucleotide
  Target: FXN; (-) strand; PAM type: YTN; PAM sequence: CTC
aagtgatccgcctgccttgg

SEQ ID NO: 28104 - DNA, 20 bp, Artificial Sequence
  Description of Artificial Sequence: Synthetic oligonucleotide
  Target: FXN; (-) strand; PAM type: YTN; PAM sequence: CTG
acctcaagtgatccgcctgc

SEQ ID NO: 28105 - DNA, 20 bp, Artificial Sequence
  Description of Artificial Sequence: Synthetic oligonucleotide
  Target: FXN; (-) strand; PAM type: YTN; PAM sequence: CTC
ctgacctcaagtgatccgcc

SEQ ID NO: 28106 - DNA, 20 bp, Artificial Sequence
  Description of Artificial Sequence: Synthetic oligonucleotide
  Target: FXN; (-) strand; PAM type: YTN; PAM sequence: CTC
aaactcctgacctcaagtga

SEQ ID NO: 28107 - DNA, 20 bp, Artificial Sequence
  Description of Artificial Sequence: Synthetic oligonucleotide
  Target: FXN; (-) strand; PAM type: YTN; PAM sequence: CTG
gtctcaaactcctgacctca

SEQ ID NO: 28108 - DNA, 20 bp, Artificial Sequence
  Description of Artificial Sequence: Synthetic oligonucleotide
  Target: FXN; (-) strand; PAM type: YTN; PAM sequence: TTG
cccaggctggtctcaaactc

SEQ ID NO: 28109 - DNA, 20 bp, Artificial Sequence
  Description of Artificial Sequence: Synthetic oligonucleotide
  Target: FXN; (-) strand; PAM type: YTN; PAM sequence: CTA
tgttgcccaggctggtctca

SEQ ID NO: 28110 - DNA, 20 bp, Artificial Sequence
  Description of Artificial Sequence: Synthetic oligonucleotide
  Target: FXN; (-) strand; PAM type: YTN; PAM sequence: TTC
actatgttgcccaggctggt

SEQ ID NO: 28111 - DNA, 20 bp, Artificial Sequence
  Description of Artificial Sequence: Synthetic oligonucleotide
  Target: FXN; (-) strand; PAM type: YTN; PAM sequence: TTT
cactatgttgcccaggctgg

SEQ ID NO: 28112 - DNA, 20 bp, Artificial Sequence
  Description of Artificial Sequence: Synthetic oligonucleotide
  Target: FXN; (-) strand; PAM type: YTN; PAM sequence: TTA
gtagagacagggtttcacta

SEQ ID NO: 28113 - DNA, 20 bp, Artificial Sequence
  Description of Artificial Sequence: Synthetic oligonucleotide
  Target: FXN; (-) strand; PAM type: YTN; PAM sequence: TTT
agtagagacagggtttcact

SEQ ID NO: 28114 - DNA, 20 bp, Artificial Sequence
  Description of Artificial Sequence: Synthetic oligonucleotide
  Target: FXN; (-) strand; PAM type: YTN; PAM sequence: TTT
tagtagagacagggtttcac

SEQ ID NO: 28115 - DNA, 20 bp, Artificial Sequence
  Description of Artificial Sequence: Synthetic oligonucleotide
  Target: FXN; (-) strand; PAM type: YTN; PAM sequence: TTT
ttagtagagacagggtttca

SEQ ID NO: 28116 - DNA, 20 bp, Artificial Sequence
  Description of Artificial Sequence: Synthetic oligonucleotide
  Target: FXN; (-) strand; PAM type: YTN; PAM sequence: TTG
tatttttagtagagacaggg

SEQ ID NO: 28117 - DNA, 20 bp, Artificial Sequence
  Description of Artificial Sequence: Synthetic oligonucleotide
  Target: FXN; (-) strand; PAM type: YTN; PAM sequence: TTT
gtatttttagtagagacagg

SEQ ID NO: 28118 - DNA, 20 bp, Artificial Sequence
  Description of Artificial Sequence: Synthetic oligonucleotide
  Target: FXN; (-) strand; PAM type: YTN; PAM sequence: TTT
tgtatttttagtagagacag

SEQ ID NO: 28119 - DNA, 20 bp, Artificial Sequence
  Description of Artificial Sequence: Synthetic oligonucleotide
  Target: FXN; (-) strand; PAM type: YTN; PAM sequence: TTT
ttgtatttttagtagagaca

SEQ ID NO: 28120 - DNA, 20 bp, Artificial Sequence
  Description of Artificial Sequence: Synthetic oligonucleotide
  Target: FXN; (-) strand; PAM type: YTN; PAM sequence: TTT
tttgtatttttagtagagac

SEQ ID NO: 28121 - DNA, 20 bp, Artificial Sequence
  Description of Artificial Sequence: Synthetic oligonucleotide
  Target: FXN; (-) strand; PAM type: YTN; PAM sequence: CTG
gcgaattttttgtattttta

SEQ ID NO: 28122 - DNA, 20 bp, Artificial Sequence
  Description of Artificial Sequence: Synthetic oligonucleotide
  Target: FXN; (-) strand; PAM type: YTN; PAM sequence: CTG
ccaccatgcctggcgaattt

SEQ ID NO: 28123 - DNA, 20 bp, Artificial Sequence
  Description of Artificial Sequence: Synthetic oligonucleotide
  Target: FXN; (-) strand; PAM type: YTN; PAM sequence: TTA
caggtgcctgccaccatgcc

SEQ ID NO: 28124 - DNA, 20 bp, Artificial Sequence
  Description of Artificial Sequence: Synthetic oligonucleotide
  Target: FXN; (-) strand; PAM type: YTN; PAM sequence: CTG
ggattacaggtgcctgccac

SEQ ID NO: 28125 - DNA, 20 bp, Artificial Sequence
  Description of Artificial Sequence: Synthetic oligonucleotide
  Target: FXN; (-) strand; PAM type: YTN; PAM sequence: CTC
ccaagcagctgggattacag

SEQ ID NO: 28126 - DNA, 20 bp, Artificial Sequence
  Description of Artificial Sequence: Synthetic oligonucleotide
  Target: FXN; (-) strand; PAM type: YTN; PAM sequence: CTC
agtctcccaagcagctggga

SEQ ID NO: 28127 - DNA, 20 bp, Artificial Sequence
  Description of Artificial Sequence: Synthetic oligonucleotide
  Target: FXN; (-) strand; PAM type: YTN; PAM sequence: CTG
tctcagtctcccaagcagct

SEQ ID NO: 28128 - DNA, 20 bp, Artificial Sequence
  Description of Artificial Sequence: Synthetic oligonucleotide
  Target: FXN; (-) strand; PAM type: YTN; PAM sequence: CTC
ctgtctcagtctcccaagca

SEQ ID NO: 28129 - DNA, 20 bp, Artificial Sequence
  Description of Artificial Sequence: Synthetic oligonucleotide
  Target: FXN; (-) strand; PAM type: YTN; PAM sequence: TTC
tcctgtctcagtctcccaag

SEQ ID NO: 28130 - DNA, 20 bp, Artificial Sequence
  Description of Artificial Sequence: Synthetic oligonucleotide
  Target: FXN; (-) strand; PAM type: YTN; PAM sequence: TTC
aagcaattctcctgtctcag

SEQ ID NO: 28131 - DNA, 20 bp, Artificial Sequence
  Description of Artificial Sequence: Synthetic oligonucleotide
  Target: FXN; (-) strand; PAM type: YTN; PAM sequence: CTG
ggttcaagcaattctcctgt

SEQ ID NO: 28132 - DNA, 20 bp, Artificial Sequence
  Description of Artificial Sequence: Synthetic oligonucleotide
  Target: FXN; (-) strand; PAM type: YTN; PAM sequence: CTC
ctgggttcaagcaattctcc

SEQ ID NO: 28133 - DNA, 20 bp, Artificial Sequence
  Description of Artificial Sequence: Synthetic oligonucleotide
  Target: FXN; (-) strand; PAM type: YTN; PAM sequence: TTC
gcctcctgggttcaagcaat

SEQ ID NO: 28134 - DNA, 20 bp, Artificial Sequence
  Description of Artificial Sequence: Synthetic oligonucleotide
  Target: FXN; (-) strand; PAM type: YTN; PAM sequence: CTT
cgcctcctgggttcaagcaa

SEQ ID NO: 28135 - DNA, 20 bp, Artificial Sequence
  Description of Artificial Sequence: Synthetic oligonucleotide
  Target: FXN; (-) strand; PAM type: YTN; PAM sequence: TTA
caaccttcgcctcctgggtt

SEQ ID NO: 28136 - DNA, 20 bp, Artificial Sequence
  Description of Artificial Sequence: Synthetic oligonucleotide
  Target: FXN; (-) strand; PAM type: YTN; PAM sequence: TTC
gttacaaccttcgcctcctg

SEQ ID NO: 28137 - DNA, 20 bp, Artificial Sequence
  Description of Artificial Sequence: Synthetic oligonucleotide
  Target: FXN; (-) strand; PAM type: YTN; PAM sequence: TTC
agttcgttacaaccttcgcc

SEQ ID NO: 28138 - DNA, 20 bp, Artificial Sequence
  Description of Artificial Sequence: Synthetic oligonucleotide
  Target: FXN; (-) strand; PAM type: YTN; PAM sequence: TTT
cagttcgttacaaccttcgc

SEQ ID NO: 28139 - DNA, 20 bp, Artificial Sequence
  Description of Artificial Sequence: Synthetic oligonucleotide
  Target: FXN; (-) strand; PAM type: YTN; PAM sequence: CTG
tggcacgatttcagttcgtt

SEQ ID NO: 28140 - DNA, 20 bp, Artificial Sequence
  Description of Artificial Sequence: Synthetic oligonucleotide
  Target: FXN; (-) strand; PAM type: YTN; PAM sequence: CTG
tcgcccaggatggagtgctg

SEQ ID NO: 28141 - DNA, 20 bp, Artificial Sequence
  Description of Artificial Sequence: Synthetic oligonucleotide
  Target: FXN; (-) strand; PAM type: YTN; PAM sequence: CTC
tgtcgcccaggatggagtgc

SEQ ID NO: 28142 - DNA, 20 bp, Artificial Sequence
  Description of Artificial Sequence: Synthetic oligonucleotide
  Target: FXN; (-) strand; PAM type: YTN; PAM sequence: CTC
actctgtcgcccaggatgga

SEQ ID NO: 28143 - DNA, 20 bp, Artificial Sequence
  Description of Artificial Sequence: Synthetic oligonucleotide
  Target: FXN; (-) strand; PAM type: YTN; PAM sequence: TTG
agacagtctcactctgtcgc

SEQ ID NO: 28144 - DNA, 20 bp, Artificial Sequence
  Description of Artificial Sequence: Synthetic oligonucleotide
  Target: FXN; (-) strand; PAM type: YTN; PAM sequence: TTT
gagacagtctcactctgtcg

SEQ ID NO: 28145 - DNA, 20 bp, Artificial Sequence
  Description of Artificial Sequence: Synthetic oligonucleotide
  Target: FXN; (-) strand; PAM type: YTN; PAM sequence: TTT
tgagacagtctcactctgtc

SEQ ID NO: 28146 - DNA, 20 bp, Artificial Sequence
  Description of Artificial Sequence: Synthetic oligonucleotide
  Target: FXN; (-) strand; PAM type: YTN; PAM sequence: TTT
ttgagacagtctcactctgt

SEQ ID NO: 28147 - DNA, 20 bp, Artificial Sequence
  Description of Artificial Sequence: Synthetic oligonucleotide
  Target: FXN; (-) strand; PAM type: YTN; PAM sequence: TTT
tttgagacagtctcactctg

SEQ ID NO: 28148 - DNA, 20 bp, Artificial Sequence
  Description of Artificial Sequence: Synthetic oligonucleotide
  Target: FXN; (-) strand; PAM type: YTN; PAM sequence: TTT
ttttgagacagtctcactct

SEQ ID NO: 28149 - DNA, 20 bp, Artificial Sequence
  Description of Artificial Sequence: Synthetic oligonucleotide
  Target: FXN; (-) strand; PAM type: YTN; PAM sequence: CTT
tttttgagacagtctcactc

SEQ ID NO: 28150 - DNA, 20 bp, Artificial Sequence
  Description of Artificial Sequence: Synthetic oligonucleotide
  Target: FXN; (-) strand; PAM type: YTN; PAM sequence: CTC
ctttttttgagacagtctca

SEQ ID NO: 28151 - DNA, 20 bp, Artificial Sequence
  Description of Artificial Sequence: Synthetic oligonucleotide
  Target: FXN; (-) strand; PAM type: YTN; PAM sequence: CTC
ctcctttttttgagacagtc

SEQ ID NO: 28152 - DNA, 20 bp, Artificial Sequence
  Description of Artificial Sequence: Synthetic oligonucleotide
  Target: FXN; (-) strand; PAM type: YTN; PAM sequence: TTC
tcctcctttttttgagacag

SEQ ID NO: 28153 - DNA, 20 bp, Artificial Sequence
  Description of Artificial Sequence: Synthetic oligonucleotide
  Target: FXN; (-) strand; PAM type: YTN; PAM sequence: CTT
ctcctcctttttttgagaca

SEQ ID NO: 28154 - DNA, 20 bp, Artificial Sequence
  Description of Artificial Sequence: Synthetic oligonucleotide
  Target: FXN; (-) strand; PAM type: YTN; PAM sequence: TTC
ttctcctcctttttttgaga

SEQ ID NO: 28155 - DNA, 20 bp, Artificial Sequence
  Description of Artificial Sequence: Synthetic oligonucleotide
  Target: FXN; (-) strand; PAM type: YTN; PAM sequence: CTT
cttctcctcctttttttgag

SEQ ID NO: 28156 - DNA, 20 bp, Artificial Sequence
  Description of Artificial Sequence: Synthetic oligonucleotide
  Target: FXN; (-) strand; PAM type: YTN; PAM sequence: TTC
cttcttctcctccttttttt

SEQ ID NO: 28157 - DNA, 20 bp, Artificial Sequence
  Description of Artificial Sequence: Synthetic oligonucleotide
  Target: FXN; (-) strand; PAM type: YTN; PAM sequence: TTT
ccttcttctcctcctttttt

SEQ ID NO: 28158 - DNA, 20 bp, Artificial Sequence
  Description of Artificial Sequence: Synthetic oligonucleotide
  Target: FXN; (-) strand; PAM type: YTN; PAM sequence: CTT
tccttcttctcctccttttt

SEQ ID NO: 28159 - DNA, 20 bp, Artificial Sequence
  Description of Artificial Sequence: Synthetic oligonucleotide
  Target: FXN; (-) strand; PAM type: YTN; PAM sequence: TTG
gcctttccttcttctcctcc

SEQ ID NO: 28160 - DNA, 20 bp, Artificial Sequence
  Description of Artificial Sequence: Synthetic oligonucleotide
  Target: FXN; (-) strand; PAM type: YTN; PAM sequence: CTT
ggcctttccttcttctcctc

SEQ ID NO: 28161 - DNA, 20 bp, Artificial Sequence
  Description of Artificial Sequence: Synthetic oligonucleotide
  Target: FXN; (-) strand; PAM type: YTN; PAM sequence: CTG
ccttggcctttccttcttct

SEQ ID NO: 28162 - DNA, 20 bp, Artificial Sequence
  Description of Artificial Sequence: Synthetic oligonucleotide
  Target: FXN; (-) strand; PAM type: YTN; PAM sequence: TTC
ctgccttggcctttccttct

SEQ ID NO: 28163 - DNA, 20 bp, Artificial Sequence
  Description of Artificial Sequence: Synthetic oligonucleotide
  Target: FXN; (-) strand; PAM type: YTN; PAM sequence: TTC
attcctgccttggcctttcc

SEQ ID NO: 28164 - DNA, 20 bp, Artificial Sequence
  Description of Artificial Sequence: Synthetic oligonucleotide
  Target: FXN; (-) strand; PAM type: YTN; PAM sequence: TTT
cattcctgccttggcctttc

SEQ ID NO: 28165 - DNA, 20 bp, Artificial Sequence
  Description of Artificial Sequence: Synthetic oligonucleotide
  Target: FXN; (-) strand; PAM type: YTN; PAM sequence: CTG
tttcattcctgccttggcct

SEQ ID NO: 28166 - DNA, 20 bp, Artificial Sequence
  Description of Artificial Sequence: Synthetic oligonucleotide
  Target: FXN; (-) strand; PAM type: YTN; PAM sequence: TTC
atggcctgtttcattcctgc

SEQ ID NO: 28167 - DNA, 20 bp, Artificial Sequence
  Description of Artificial Sequence: Synthetic oligonucleotide
  Target: FXN; (-) strand; PAM type: YTN; PAM sequence: CTC
caacattcatggcctgtttc

SEQ ID NO: 28168 - DNA, 20 bp, Artificial Sequence
  Description of Artificial Sequence: Synthetic oligonucleotide
  Target: FXN; (-) strand; PAM type: YTN; PAM sequence: TTC
actccaacattcatggcctg

SEQ ID NO: 28169 - DNA, 20 bp, Artificial Sequence
  Description of Artificial Sequence: Synthetic oligonucleotide
  Target: FXN; (-) strand; PAM type: YTN; PAM sequence: CTT
cactccaacattcatggcct

SEQ ID NO: 28170 - DNA, 20 bp, Artificial Sequence
  Description of Artificial Sequence: Synthetic oligonucleotide
  Target: FXN; (-) strand; PAM type: YTN; PAM sequence: TTG
cttcactccaacattcatgg

SEQ ID NO: 28171 - DNA, 20 bp, Artificial Sequence
  Description of Artificial Sequence: Synthetic oligonucleotide
  Target: FXN; (-) strand; PAM type: YTN; PAM sequence: TTA
gcacgaggaggccagttgct

SEQ ID NO: 28172 - DNA, 20 bp, Artificial Sequence
  Description of Artificial Sequence: Synthetic oligonucleotide
  Target: FXN; (-) strand; PAM type: YTN; PAM sequence: CTT
agcacgaggaggccagttgc

SEQ ID NO: 28173 - DNA, 20 bp, Artificial Sequence
  Description of Artificial Sequence: Synthetic oligonucleotide
  Target: FXN; (-) strand; PAM type: YTN; PAM sequence: CTC
acagtagccgcttagcacga

SEQ ID NO: 28174 - DNA, 20 bp, Artificial Sequence
  Description of Artificial Sequence: Synthetic oligonucleotide
  Target: FXN; (-) strand; PAM type: YTN; PAM sequence: TTG
ggggagtggaaagaactcac

SEQ ID NO: 28175 - DNA, 20 bp, Artificial Sequence
  Description of Artificial Sequence: Synthetic oligonucleotide
  Target: FXN; (-) strand; PAM type: YTN; PAM sequence: CTT
gggggagtggaaagaactca

SEQ ID NO: 28176 - DNA, 20 bp, Artificial Sequence
  Description of Artificial Sequence: Synthetic oligonucleotide
  Target: FXN; (-) strand; PAM type: YTN; PAM sequence: TTA
tgcaatgtcttgggggagtg

SEQ ID NO: 28177 - DNA, 20 bp, Artificial Sequence
  Description of Artificial Sequence: Synthetic oligonucleotide
  Target: FXN; (-) strand; PAM type: YTN; PAM sequence: TTT
atgcaatgtcttgggggagt

SEQ ID NO: 28178 - DNA, 20 bp, Artificial Sequence
  Description of Artificial Sequence: Synthetic oligonucleotide
  Target: FXN; (-) strand; PAM type: YTN; PAM sequence: TTA
tttatgcaatgtcttggggg

SEQ ID NO: 28179 - DNA, 20 bp, Artificial Sequence
  Description of Artificial Sequence: Synthetic oligonucleotide
  Target: FXN; (-) strand; PAM type: YTN; PAM sequence: TTC
agcggggtgagtgtcagaaa

SEQ ID NO: 28180 - DNA, 20 bp, Artificial Sequence
  Description of Artificial Sequence: Synthetic oligonucleotide
  Target: FXN; (-) strand; PAM type: YTN; PAM sequence: TTG
agcagaggcaggacattcag

SEQ ID NO: 28181 - DNA, 20 bp, Artificial Sequence
  Description of Artificial Sequence: Synthetic oligonucleotide
  Target: FXN; (-) strand; PAM type: YTN; PAM sequence: CTT
gagcagaggcaggacattca

SEQ ID NO: 28182 - DNA, 20 bp, Artificial Sequence
  Description of Artificial Sequence: Synthetic oligonucleotide
  Target: FXN; (-) strand; PAM type: YTN; PAM sequence: CTG
ccaagtccccatcataccac

SEQ ID NO: 28183 - DNA, 20 bp, Artificial Sequence
  Description of Artificial Sequence: Synthetic oligonucleotide
  Target: FXN; (-) strand; PAM type: YTN; PAM sequence: CTC
cactgccaagtccccatcat

SEQ ID NO: 28184 - DNA, 20 bp, Artificial Sequence
  Description of Artificial Sequence: Synthetic oligonucleotide
  Target: FXN; (-) strand; PAM type: YTN; PAM sequence: TTC
ccctccactgccaagtcccc

SEQ ID NO: 28185 - DNA, 20 bp, Artificial Sequence
  Description of Artificial Sequence: Synthetic oligonucleotide
  Target: FXN; (-) strand; PAM type: YTN; PAM sequence: CTG
ttcccctccactgccaagtc

SEQ ID NO: 28186 - DNA, 20 bp, Artificial Sequence
  Description of Artificial Sequence: Synthetic oligonucleotide
  Target: FXN; (-) strand; PAM type: YTN; PAM sequence: TTC
cctgttcccctccactgcca

SEQ ID NO: 28187 - DNA, 20 bp, Artificial Sequence
  Description of Artificial Sequence: Synthetic oligonucleotide
  Target: FXN; (-) strand; PAM type: YTN; PAM sequence: TTT
ccctgttcccctccactgcc

SEQ ID NO: 28188 - DNA, 20 bp, Artificial Sequence
  Description of Artificial Sequence: Synthetic oligonucleotide
  Target: FXN; (-) strand; PAM type: YTN; PAM sequence: CTG
gtttccctgttcccctccac

SEQ ID NO: 28189 - DNA, 20 bp, Artificial Sequence
  Description of Artificial Sequence: Synthetic oligonucleotide
  Target: FXN; (-) strand; PAM type: YTN; PAM sequence: TTG
tagccaggaagcggggagac

SEQ ID NO: 28190 - DNA, 20 bp, Artificial Sequence
  Description of Artificial Sequence: Synthetic oligonucleotide
  Target: FXN; (-) strand; PAM type: YTN; PAM sequence: CTT
gtagccaggaagcggggaga

SEQ ID NO: 28191 - DNA, 20 bp, Artificial Sequence
  Description of Artificial Sequence: Synthetic oligonucleotide
  Target: FXN; (-) strand; PAM type: YTN; PAM sequence: TTC
agagggacttgtagccagga

SEQ ID NO: 28192 - DNA, 20 bp, Artificial Sequence
  Description of Artificial Sequence: Synthetic oligonucleotide
  Target: FXN; (-) strand; PAM type: YTN; PAM sequence: CTT
cagagggacttgtagccagg

SEQ ID NO: 28193 - DNA, 20 bp, Artificial Sequence
  Description of Artificial Sequence: Synthetic oligonucleotide
  Target: FXN; (-) strand; PAM type: YTN; PAM sequence: TTC
ttcagagggacttgtagcca

SEQ ID NO: 28194 - DNA, 20 bp, Artificial Sequence
  Description of Artificial Sequence: Synthetic oligonucleotide
  Target: FXN; (-) strand; PAM type: YTN; PAM sequence: TTT
cttcagagggacttgtagcc

SEQ ID NO: 28195 - DNA, 20 bp, Artificial Sequence
  Description of Artificial Sequence: Synthetic oligonucleotide
  Target: FXN; (-) strand; PAM type: YTN; PAM sequence: TTG
gatttcttcagagggacttg

SEQ ID NO: 28196 - DNA, 20 bp, Artificial Sequence
  Description of Artificial Sequence: Synthetic oligonucleotide
  Target: FXN; (-) strand; PAM type: YTN; PAM sequence: TTT
ggatttcttcagagggactt

SEQ ID NO: 28197 - DNA, 20 bp, Artificial Sequence
  Description of Artificial Sequence: Synthetic oligonucleotide
  Target: FXN; (-) strand; PAM type: YTN; PAM sequence: CTT
tggatttcttcagagggact

SEQ ID NO: 28198 - DNA, 20 bp, Artificial Sequence
  Description of Artificial Sequence: Synthetic oligonucleotide
  Target: FXN; (-) strand; PAM type: YTN; PAM sequence: CTC
ctttggatttcttcagaggg

SEQ ID NO: 28199 - DNA, 20 bp, Artificial Sequence
  Description of Artificial Sequence: Synthetic oligonucleotide
  Target: FXN; (-) strand; PAM type: YTN; PAM sequence: TTA
ctcctttggatttcttcaga

SEQ ID NO: 28200 - DNA, 20 bp, Artificial Sequence
  Description of Artificial Sequence: Synthetic oligonucleotide
  Target: FXN; (-) strand; PAM type: YTN; PAM sequence: TTT
actcctttggatttcttcag

SEQ ID NO: 28201 - DNA, 20 bp, Artificial Sequence
  Description of Artificial Sequence: Synthetic oligonucleotide
  Target: FXN; (-) strand; PAM type: YTN; PAM sequence: CTT
tactcctttggatttcttca

SEQ ID NO: 28202 - DNA, 20 bp, Artificial Sequence
  Description of Artificial Sequence: Synthetic oligonucleotide
  Target: FXN; (-) strand; PAM type: YTN; PAM sequence: CTC
tttactcctttggatttctt

SEQ ID NO: 28203 - DNA, 20 bp, Artificial Sequence
  Description of Artificial Sequence: Synthetic oligonucleotide
  Target: FXN; (-) strand; PAM type: YTN; PAM sequence: CTC
caagctctttactcctttgg

SEQ ID NO: 28204 - DNA, 20 bp, Artificial Sequence
  Description of Artificial Sequence: Synthetic oligonucleotide
  Target: FXN; (-) strand; PAM type: YTN; PAM sequence: CTC
tccaagctctttactccttt

SEQ ID NO: 28205 - DNA, 20 bp, Artificial Sequence
  Description of Artificial Sequence: Synthetic oligonucleotide
  Target: FXN; (-) strand; PAM type: YTN; PAM sequence: CTA
ctctccaagctctttactcc

SEQ ID NO: 28206 - DNA, 20 bp, Artificial Sequence
  Description of Artificial Sequence: Synthetic oligonucleotide
  Target: FXN; (-) strand; PAM type: YTN; PAM sequence: CTA
cagaggcctactctccaagc

SEQ ID NO: 28207 - DNA, 20 bp, Artificial Sequence
  Description of Artificial Sequence: Synthetic oligonucleotide
  Target: FXN; (-) strand; PAM type: YTN; PAM sequence: TTG
caccctacagaggcctactc

SEQ ID NO: 28208 - DNA, 20 bp, Artificial Sequence
  Description of Artificial Sequence: Synthetic oligonucleotide
  Target: FXN; (-) strand; PAM type: YTN; PAM sequence: CTT
gcaccctacagaggcctact

SEQ ID NO: 28209 - DNA, 20 bp, Artificial Sequence
  Description of Artificial Sequence: Synthetic oligonucleotide
  Target: FXN; (-) strand; PAM type: YTN; PAM sequence: CTG
tgcccttgcaccctacagag

SEQ ID NO: 28210 - DNA, 20 bp, Artificial Sequence
  Description of Artificial Sequence: Synthetic oligonucleotide
  Target: FXN; (-) strand; PAM type: YTN; PAM sequence: CTC
cagctgtgcccttgcaccct

SEQ ID NO: 28211 - DNA, 20 bp, Artificial Sequence
  Description of Artificial Sequence: Synthetic oligonucleotide
  Target: FXN; (-) strand; PAM type: YTN; PAM sequence: CTC
cgtctccagctgtgcccttg

SEQ ID NO: 28212 - DNA, 20 bp, Artificial Sequence
  Description of Artificial Sequence: Synthetic oligonucleotide
  Target: FXN; (-) strand; PAM type: YTN; PAM sequence: CTC
aggagctccgtctccagctg

SEQ ID NO: 28213 - DNA, 20 bp, Artificial Sequence
  Description of Artificial Sequence: Synthetic oligonucleotide
  Target: FXN; (-) strand; PAM type: YTN; PAM sequence: CTG
cagcctcaggagctccgtct

SEQ ID NO: 28214 - DNA, 20 bp, Artificial Sequence
  Description of Artificial Sequence: Synthetic oligonucleotide
  Target: FXN; (-) strand; PAM type: YTN; PAM sequence: TTC
aggcagagcgggcagcatca

SEQ ID NO: 28215 - DNA, 20 bp, Artificial Sequence
  Description of Artificial Sequence: Synthetic oligonucleotide
  Target: FXN; (-) strand; PAM type: YTN; PAM sequence: TTG
gtgcagttcaggcagagcgg

SEQ ID NO: 28216 - DNA, 20 bp, Artificial Sequence
  Description of Artificial Sequence: Synthetic oligonucleotide
  Target: FXN; (-) strand; PAM type: YTN; PAM sequence: TTT
ggtgcagttcaggcagagcg

SEQ ID NO: 28217 - DNA, 20 bp, Artificial Sequence
  Description of Artificial Sequence: Synthetic oligonucleotide
  Target: FXN; (-) strand; PAM type: YTN; PAM sequence: TTT
tggtgcagttcaggcagagc

SEQ ID NO: 28218 - DNA, 20 bp, Artificial Sequence
  Description of Artificial Sequence: Synthetic oligonucleotide
  Target: FXN; (-) strand; PAM type: YTN; PAM sequence: TTT
ttggtgcagttcaggcagag

SEQ ID NO: 28219 - DNA, 20 bp, Artificial Sequence
  Description of Artificial Sequence: Synthetic oligonucleotide
  Target: FXN; (-) strand; PAM type: YTN; PAM sequence: CTC
atcacgtttttggtgcagtt

SEQ ID NO: 28220 - DNA, 20 bp, Artificial Sequence
  Description of Artificial Sequence: Synthetic oligonucleotide
  Target: FXN; (-) strand; PAM type: YTN; PAM sequence: CTA
tggcctcatcacgtttttgg

SEQ ID NO: 28221 - DNA, 20 bp, Artificial Sequence
  Description of Artificial Sequence: Synthetic oligonucleotide
  Target: FXN; (-) strand; PAM type: YTN; PAM sequence: CTC
ccgctatggcctcatcacgt

SEQ ID NO: 28222 - DNA, 20 bp, Artificial Sequence
  Description of Artificial Sequence: Synthetic oligonucleotide
  Target: FXN; (-) strand; PAM type: YTN; PAM sequence: CTC
cgtggactcccgctatggcc

SEQ ID NO: 28223 - DNA, 20 bp, Artificial Sequence
  Description of Artificial Sequence: Synthetic oligonucleotide
  Target: FXN; (-) strand; PAM type: YTN; PAM sequence: CTC
ctccgtggactcccgctatg

SEQ ID NO: 28224 - DNA, 20 bp, Artificial Sequence
  Description of Artificial Sequence: Synthetic oligonucleotide
  Target: FXN; (-) strand; PAM type: YTN; PAM sequence: CTA
gaggtcgggcagtaggcatc

SEQ ID NO: 28225 - DNA, 20 bp, Artificial Sequence
  Description of Artificial Sequence: Synthetic oligonucleotide
  Target: FXN; (-) strand; PAM type: YTN; PAM sequence: CTG
ctagaggtcgggcagtaggc

SEQ ID NO: 28226 - DNA, 20 bp, Artificial Sequence
  Description of Artificial Sequence: Synthetic oligonucleotide
  Target: FXN; (-) strand; PAM type: YTN; PAM sequence: CTC
tgctagaggtcgggcagtag

SEQ ID NO: 28227 - DNA, 20 bp, Artificial Sequence
  Description of Artificial Sequence: Synthetic oligonucleotide
  Target: FXN; (-) strand; PAM type: YTN; PAM sequence: TTA
gtctctgctagaggtcgggc

SEQ ID NO: 28228 - DNA, 20 bp, Artificial Sequence
  Description of Artificial Sequence: Synthetic oligonucleotide
  Target: FXN; (-) strand; PAM type: YTN; PAM sequence: CTT
agtctctgctagaggtcggg

SEQ ID NO: 28229 - DNA, 20 bp, Artificial Sequence
  Description of Artificial Sequence: Synthetic oligonucleotide
  Target: FXN; (-) strand; PAM type: YTN; PAM sequence: TTG
cttagtctctgctagaggtc

SEQ ID NO: 28230 - DNA, 20 bp, Artificial Sequence
  Description of Artificial Sequence: Synthetic oligonucleotide
  Target: FXN; (-) strand; PAM type: YTN; PAM sequence: CTT
gcttagtctctgctagaggt

SEQ ID NO: 28231 - DNA, 20 bp, Artificial Sequence
  Description of Artificial Sequence: Synthetic oligonucleotide
  Target: FXN; (-) strand; PAM type: YTN; PAM sequence: TTC
atgcaccttgcttagtctct

SEQ ID NO: 28232 - DNA, 20 bp, Artificial Sequence
  Description of Artificial Sequence: Synthetic oligonucleotide
  Target: FXN; (-) strand; PAM type: YTN; PAM sequence: TTT
catgcaccttgcttagtctc

SEQ ID NO: 28233 - DNA, 20 bp, Artificial Sequence
  Description of Artificial Sequence: Synthetic oligonucleotide
  Target: FXN; (-) strand; PAM type: YTN; PAM sequence: TTT
tcatgcaccttgcttagtct

SEQ ID NO: 28234 - DNA, 20 bp, Artificial Sequence
  Description of Artificial Sequence: Synthetic oligonucleotide
  Target: FXN; (-) strand; PAM type: YTN; PAM sequence: TTC
aagttttcatgcaccttgct

SEQ ID NO: 28235 - DNA, 20 bp, Artificial Sequence
  Description of Artificial Sequence: Synthetic oligonucleotide
  Target: FXN; (-) strand; PAM type: YTN; PAM sequence: TTC
atgtagtggtcatgggtgtg

SEQ ID NO: 28236 - DNA, 20 bp, Artificial Sequence
  Description of Artificial Sequence: Synthetic oligonucleotide
  Target: FXN; (-) strand; PAM type: YTN; PAM sequence: CTT
catgtagtggtcatgggtgt

SEQ ID NO: 28237 - DNA, 20 bp, Artificial Sequence
  Description of Artificial Sequence: Synthetic oligonucleotide
  Target: FXN; (-) strand; PAM type: YTN; PAM sequence: TTG
ggccatcttcatgtagtggt

SEQ ID NO: 28238 - DNA, 20 bp, Artificial Sequence
  Description of Artificial Sequence: Synthetic oligonucleotide
  Target: FXN; (-) strand; PAM type: YTN; PAM sequence: TTT
gggccatcttcatgtagtgg

SEQ ID NO: 28239 - DNA, 20 bp, Artificial Sequence
  Description of Artificial Sequence: Synthetic oligonucleotide
  Target: FXN; (-) strand; PAM type: YTN; PAM sequence: TTT
tgggccatcttcatgtagtg

SEQ ID NO: 28240 - DNA, 20 bp, Artificial Sequence
  Description of Artificial Sequence: Synthetic oligonucleotide
  Target: FXN; (-) strand; PAM type: YTN; PAM sequence: CTG
ggccaggttttgggccatct

SEQ ID NO: 28241 - DNA, 20 bp, Artificial Sequence
  Description of Artificial Sequence: Synthetic oligonucleotide
  Target: FXN; (-) strand; PAM type: YTN; PAM sequence: TTC
ctgggccaggttttgggcca

SEQ ID NO: 28242 - DNA, 20 bp, Artificial Sequence
  Description of Artificial Sequence: Synthetic oligonucleotide
  Target: FXN; (-) strand; PAM type: YTN; PAM sequence: TTC
aattcctgggccaggttttg

SEQ ID NO: 28243 - DNA, 20 bp, Artificial Sequence
  Description of Artificial Sequence: Synthetic oligonucleotide
  Target: FXN; (-) strand; PAM type: YTN; PAM sequence: CTT
caattcctgggccaggtttt

SEQ ID NO: 28244 - DNA, 20 bp, Artificial Sequence
  Description of Artificial Sequence: Synthetic oligonucleotide
  Target: FXN; (-) strand; PAM type: YTN; PAM sequence: TTC
ttcaattcctgggccaggtt

SEQ ID NO: 28245 - DNA, 20 bp, Artificial Sequence
  Description of Artificial Sequence: Synthetic oligonucleotide
  Target: FXN; (-) strand; PAM type: YTN; PAM sequence: TTT
cttcaattcctgggccaggt

SEQ ID NO: 28246 - DNA, 20 bp, Artificial Sequence
  Description of Artificial Sequence: Synthetic oligonucleotide
  Target: FXN; (-) strand; PAM type: YTN; PAM sequence: CTT
tcttcaattcctgggccagg

SEQ ID NO: 28247 - DNA, 20 bp, Artificial Sequence
  Description of Artificial Sequence: Synthetic oligonucleotide
  Target: FXN; (-) strand; PAM type: YTN; PAM sequence: TTG
gaagagtctttcttcaattc

SEQ ID NO: 28248 - DNA, 20 bp, Artificial Sequence
  Description of Artificial Sequence: Synthetic oligonucleotide
  Target: FXN; (-) strand; PAM type: YTN; PAM sequence: TTA
cagcaaattggaagagtctt

SEQ ID NO: 28249 - DNA, 20 bp, Artificial Sequence
  Description of Artificial Sequence: Synthetic oligonucleotide
  Target: FXN; (-) strand; PAM type: YTN; PAM sequence: CTT
acagcaaattggaagagtct

SEQ ID NO: 28250 - DNA, 20 bp, Artificial Sequence
  Description of Artificial Sequence: Synthetic oligonucleotide
  Target: FXN; (-) strand; PAM type: YTN; PAM sequence: TTC
ttacagcaaattggaagagt

SEQ ID NO: 28251 - DNA, 20 bp, Artificial Sequence
  Description of Artificial Sequence: Synthetic oligonucleotide
  Target: FXN; (-) strand; PAM type: YTN; PAM sequence: TTT
cttacagcaaattggaagag

SEQ ID NO: 28252 - DNA, 20 bp, Artificial Sequence
  Description of Artificial Sequence: Synthetic oligonucleotide
  Target: FXN; (-) strand; PAM type: YTN; PAM sequence: TTT
tcttacagcaaattggaaga

SEQ ID NO: 28253 - DNA, 20 bp, Artificial Sequence
  Description of Artificial Sequence: Synthetic oligonucleotide
  Target: FXN; (-) strand; PAM type: YTN; PAM sequence: CTG
ggccattttcttacagcaaa

SEQ ID NO: 28254 - DNA, 20 bp, Artificial Sequence
  Description of Artificial Sequence: Synthetic oligonucleotide
  Target: FXN; (-) strand; PAM type: YTN; PAM sequence: TTG
ccccctgggccattttctta

SEQ ID NO: 28255 - DNA, 20 bp, Artificial Sequence
  Description of Artificial Sequence: Synthetic oligonucleotide
  Target: FXN; (-) strand; PAM type: YTN; PAM sequence: CTT
gccccctgggccattttctt

SEQ ID NO: 28256 - DNA, 20 bp, Artificial Sequence
  Description of Artificial Sequence: Synthetic oligonucleotide
  Target: FXN; (-) strand; PAM type: YTN; PAM sequence: CTA
ccgtgcttgccccctgggcc

SEQ ID NO: 28257 - DNA, 20 bp, Artificial Sequence
  Description of Artificial Sequence: Synthetic oligonucleotide
  Target: FXN; (-) strand; PAM type: YTN; PAM sequence: TTA
caggtgtgagctaccgtgct

SEQ ID NO: 28258 - DNA, 20 bp, Artificial Sequence
  Description of Artificial Sequence: Synthetic oligonucleotide
  Target: FXN; (-) strand; PAM type: YTN; PAM sequence: CTA
ggattacaggtgtgagctac

SEQ ID NO: 28259 - DNA, 20 bp, Artificial Sequence
  Description of Artificial Sequence: Synthetic oligonucleotide
  Target: FXN; (-) strand; PAM type: YTN; PAM sequence: TTC
ccaaagtgctaggattacag

SEQ ID NO: 28260 - DNA, 20 bp, Artificial Sequence
  Description of Artificial Sequence: Synthetic oligonucleotide
  Target: FXN; (-) strand; PAM type: YTN; PAM sequence: CTT
cccaaagtgctaggattaca

SEQ ID NO: 28261 - DNA, 20 bp, Artificial Sequence
  Description of Artificial Sequence: Synthetic oligonucleotide
  Target: FXN; (-) strand; PAM type: YTN; PAM sequence: CTG
cgtcagcttcccaaagtgct

SEQ ID NO: 28262 - DNA, 20 bp, Artificial Sequence
  Description of Artificial Sequence: Synthetic oligonucleotide
  Target: FXN; (-) strand; PAM type: YTN; PAM sequence: CTG
cctgcgtcagcttcccaaag

SEQ ID NO: 28263 - DNA, 20 bp, Artificial Sequence
  Description of Artificial Sequence: Synthetic oligonucleotide
  Target: FXN; (-) strand; PAM type: YTN; PAM sequence: CTC
aagccatctgcctgcgtcag

SEQ ID NO: 28264 - DNA, 20 bp, Artificial Sequence
  Description of Artificial Sequence: Synthetic oligonucleotide
  Target: FXN; (-) strand; PAM type: YTN; PAM sequence: CTG
agctcaagccatctgcctgc

SEQ ID NO: 28265 - DNA, 20 bp, Artificial Sequence
  Description of Artificial Sequence: Synthetic oligonucleotide
  Target: FXN; (-) strand; PAM type: YTN; PAM sequence: CTC
ctgagctcaagccatctgcc

SEQ ID NO: 28266 - DNA, 20 bp, Artificial Sequence
  Description of Artificial Sequence: Synthetic oligonucleotide
  Target: FXN; (-) strand; PAM type: YTN; PAM sequence: CTG
gaactcctgagctcaagcca

SEQ ID NO: 28267 - DNA, 20 bp, Artificial Sequence
  Description of Artificial Sequence: Synthetic oligonucleotide
  Target: FXN; (-) strand; PAM type: YTN; PAM sequence: CTG
gtctggaactcctgagctca

SEQ ID NO: 28268 - DNA, 20 bp, Artificial Sequence
  Description of Artificial Sequence: Synthetic oligonucleotide
  Target: FXN; (-) strand; PAM type: YTN; PAM sequence: TTG
cccaggctggtctggaactc

SEQ ID NO: 28269 - DNA, 20 bp, Artificial Sequence
  Description of Artificial Sequence: Synthetic oligonucleotide
  Target: FXN; (-) strand; PAM type: YTN; PAM sequence: TTC
accatgttgcccaggctggt

SEQ ID NO: 28270 - DNA, 20 bp, Artificial Sequence
  Description of Artificial Sequence: Synthetic oligonucleotide
  Target: FXN; (-) strand; PAM type: YTN; PAM sequence: TTT
caccatgttgcccaggctgg

SEQ ID NO: 28271 - DNA, 20 bp, Artificial Sequence
  Description of Artificial Sequence: Synthetic oligonucleotide
  Target: FXN; (-) strand; PAM type: YTN; PAM sequence: TTG
gtagagacggggtttcacca

SEQ ID NO: 28272 - DNA, 20 bp, Artificial Sequence
  Description of Artificial Sequence: Synthetic oligonucleotide
  Target: FXN; (-) strand; PAM type: YTN; PAM sequence: TTT
ggtagagacggggtttcacc

SEQ ID NO: 28273 - DNA, 20 bp, Artificial Sequence
  Description of Artificial Sequence: Synthetic oligonucleotide
  Target: FXN; (-) strand; PAM type: YTN; PAM sequence: TTT
tggtagagacggggtttcac

SEQ ID NO: 28274 - DNA, 20 bp, Artificial Sequence
  Description of Artificial Sequence: Synthetic oligonucleotide
  Target: FXN; (-) strand; PAM type: YTN; PAM sequence: TTT
ttggtagagacggggtttca

SEQ ID NO: 28275 - DNA, 20 bp, Artificial Sequence
  Description of Artificial Sequence: Synthetic oligonucleotide
  Target: FXN; (-) strand; PAM type: YTN; PAM sequence: TTG
tatttttggtagagacgggg

SEQ ID NO: 28276 - DNA, 20 bp, Artificial Sequence
  Description of Artificial Sequence: Synthetic oligonucleotide
  Target: FXN; (-) strand; PAM type: YTN; PAM sequence: TTT
gtatttttggtagagacggg

SEQ ID NO: 28277 - DNA, 20 bp, Artificial Sequence
  Description of Artificial Sequence: Synthetic oligonucleotide
  Target: FXN; (-) strand; PAM type: YTN; PAM sequence: TTT
tgtatttttggtagagacgg

SEQ ID NO: 28278 - DNA, 20 bp, Artificial Sequence
  Description of Artificial Sequence: Synthetic oligonucleotide
  Target: FXN; (-) strand; PAM type: YTN; PAM sequence: TTT
ttgtatttttggtagagacg

SEQ ID NO: 28279 - DNA, 20 bp, Artificial Sequence
  Description of Artificial Sequence: Synthetic oligonucleotide
  Target: FXN; (-) strand; PAM type: YTN; PAM sequence: CTA
atttttgtatttttggtaga

SEQ ID NO: 28280 - DNA, 20 bp, Artificial Sequence
  Description of Artificial Sequence: Synthetic oligonucleotide
  Target: FXN; (-) strand; PAM type: YTN; PAM sequence: CTG
ggaccacaggcatgcatcac

SEQ ID NO: 28281 - DNA, 20 bp, Artificial Sequence
  Description of Artificial Sequence: Synthetic oligonucleotide
  Target: FXN; (-) strand; PAM type: YTN; PAM sequence: CTG
agtagctgggaccacaggca

SEQ ID NO: 28282 - DNA, 20 bp, Artificial Sequence
  Description of Artificial Sequence: Synthetic oligonucleotide
  Target: FXN; (-) strand; PAM type: YTN; PAM sequence: CTC
ctgagtagctgggaccacag

SEQ ID NO: 28283 - DNA, 20 bp, Artificial Sequence
  Description of Artificial Sequence: Synthetic oligonucleotide
  Target: FXN; (-) strand; PAM type: YTN; PAM sequence: CTC
agcctcctgagtagctggga

SEQ ID NO: 28284 - DNA, 20 bp, Artificial Sequence
  Description of Artificial Sequence: Synthetic oligonucleotide
  Target: FXN; (-) strand; PAM type: YTN; PAM sequence: TTC
cacctcagcctcctgagtag

SEQ ID NO: 28285 - DNA, 20 bp, Artificial Sequence
  Description of Artificial Sequence: Synthetic oligonucleotide
  Target: FXN; (-) strand; PAM type: YTN; PAM sequence: CTT
ccacctcagcctcctgagta

SEQ ID NO: 28286 - DNA, 20 bp, Artificial Sequence
  Description of Artificial Sequence: Synthetic oligonucleotide
  Target: FXN; (-) strand; PAM type: YTN; PAM sequence: CTC
aggcaatccttccacctcag

SEQ ID NO: 28287 - DNA, 20 bp, Artificial Sequence
  Description of Artificial Sequence: Synthetic oligonucleotide
  Target: FXN; (-) strand; PAM type: YTN; PAM sequence: CTG
ccccacagactcaggcaatc

SEQ ID NO: 28288 - DNA, 20 bp, Artificial Sequence
  Description of Artificial Sequence: Synthetic oligonucleotide
  Target: FXN; (-) strand; PAM type: YTN; PAM sequence: CTC
tgccccacagactcaggcaa

SEQ ID NO: 28289 - DNA, 20 bp, Artificial Sequence
  Description of Artificial Sequence: Synthetic oligonucleotide
  Target: FXN; (-) strand; PAM type: YTN; PAM sequence: CTG
caacctctgccccacagact

SEQ ID NO: 28290 - DNA, 20 bp, Artificial Sequence
  Description of Artificial Sequence: Synthetic oligonucleotide
  Target: FXN; (-) strand; PAM type: YTN; PAM sequence: CTC
actgcaacctctgccccaca

SEQ ID NO: 28291 - DNA, 20 bp, Artificial Sequence
  Description of Artificial Sequence: Synthetic oligonucleotide
  Target: FXN; (-) strand; PAM type: YTN; PAM sequence: CTC
agctcactgcaacctctgcc

SEQ ID NO: 28292 - DNA, 20 bp, Artificial Sequence
  Description of Artificial Sequence: Synthetic oligonucleotide
  Target: FXN; (-) strand; PAM type: YTN; PAM sequence: CTG
gagtgcagtggtgtgatctc

SEQ ID NO: 28293 - DNA, 20 bp, Artificial Sequence
  Description of Artificial Sequence: Synthetic oligonucleotide
  Target: FXN; (-) strand; PAM type: YTN; PAM sequence: CTG
tgtcacccaggctggagtgc

SEQ ID NO: 28294 - DNA, 20 bp, Artificial Sequence
  Description of Artificial Sequence: Synthetic oligonucleotide
  Target: FXN; (-) strand; PAM type: YTN; PAM sequence: CTC
actgtgtcacccaggctgga

SEQ ID NO: 28295 - DNA, 20 bp, Artificial Sequence
  Description of Artificial Sequence: Synthetic oligonucleotide
  Target: FXN; (-) strand; PAM type: YTN; PAM sequence: TTG
agatggggtctcactgtgtc

SEQ ID NO: 28296 - DNA, 20 bp, Artificial Sequence
  Description of Artificial Sequence: Synthetic oligonucleotide
  Target: FXN; (-) strand; PAM type: YTN; PAM sequence: TTT
gagatggggtctcactgtgt

SEQ ID NO: 28297 - DNA, 20 bp, Artificial Sequence
  Description of Artificial Sequence: Synthetic oligonucleotide
  Target: FXN; (-) strand; PAM type: YTN; PAM sequence: TTT
tgagatggggtctcactgtg

SEQ ID NO: 28298 - DNA, 20 bp, Artificial Sequence
  Description of Artificial Sequence: Synthetic oligonucleotide
  Target: FXN; (-) strand; PAM type: YTN; PAM sequence: TTT
ttgagatggggtctcactgt

SEQ ID NO: 28299 - DNA, 20 bp, Artificial Sequence
  Description of Artificial Sequence: Synthetic oligonucleotide
  Target: FXN; (-) strand; PAM type: YTN; PAM sequence: TTT
tttgagatggggtctcactg

SEQ ID NO: 28300 - DNA, 20 bp, Artificial Sequence
  Description of Artificial Sequence: Synthetic oligonucleotide
  Target: FXN; (-) strand; PAM type: YTN; PAM sequence: TTT
ttttgagatggggtctcact

SEQ ID NO: 28301 - DNA, 20 bp, Artificial Sequence
  Description of Artificial Sequence: Synthetic oligonucleotide
  Target: FXN; (-) strand; PAM type: YTN; PAM sequence: TTT
tttttgagatggggtctcac

SEQ ID NO: 28302 - DNA, 20 bp, Artificial Sequence
  Description of Artificial Sequence: Synthetic oligonucleotide
  Target: FXN; (-) strand; PAM type: YTN; PAM sequence: TTT
ttttttgagatggggtctca

SEQ ID NO: 28303 - DNA, 20 bp, Artificial Sequence
  Description of Artificial Sequence: Synthetic oligonucleotide
  Target: FXN; (-) strand; PAM type: YTN; PAM sequence: TTT
tttttttgagatggggtctc

SEQ ID NO: 28304 - DNA, 20 bp, Artificial Sequence
  Description of Artificial Sequence: Synthetic oligonucleotide
  Target: FXN; (-) strand; PAM type: YTN; PAM sequence: TTT
ttttttttgagatggggtct

SEQ ID NO: 28305 - DNA, 20 bp, Artificial Sequence
  Description of Artificial Sequence: Synthetic oligonucleotide
  Target: FXN; (-) strand; PAM type: YTN; PAM sequence: TTT
tttttttttgagatggggtc

SEQ ID NO: 28306 - DNA, 20 bp, Artificial Sequence
  Description of Artificial Sequence: Synthetic oligonucleotide
  Target: FXN; (-) strand; PAM type: YTN; PAM sequence: TTT
ttttttttttgagatggggt

SEQ ID NO: 28307 - DNA, 20 bp, Artificial Sequence
  Description of Artificial Sequence: Synthetic oligonucleotide
  Target: FXN; (-) strand; PAM type: YTN; PAM sequence: TTT
tttttttttttgagatgggg

SEQ ID NO: 28308 - DNA, 20 bp, Artificial Sequence
  Description of Artificial Sequence: Synthetic oligonucleotide
  Target: FXN; (-) strand; PAM type: YTN; PAM sequence: CTT
ttttttttttttgagatggg

SEQ ID NO: 28309 - DNA, 20 bp, Artificial Sequence
  Description of Artificial Sequence: Synthetic oligonucleotide
  Target: FXN; (-) strand; PAM type: YTN; PAM sequence: TTC
ttttttttttttttgagatg

SEQ ID NO: 28310 - DNA, 20 bp, Artificial Sequence
  Description of Artificial Sequence: Synthetic oligonucleotide
  Target: FXN; (-) strand; PAM type: YTN; PAM sequence: TTT
cttttttttttttttgagat

SEQ ID NO: 28311 - DNA, 20 bp, Artificial Sequence
  Description of Artificial Sequence: Synthetic oligonucleotide
  Target: FXN; (-) strand; PAM type: YTN; PAM sequence: CTT
tcttttttttttttttgaga

SEQ ID NO: 28312 - DNA, 20 bp, Artificial Sequence
  Description of Artificial Sequence: Synthetic oligonucleotide
  Target: FXN; (-) strand; PAM type: YTN; PAM sequence: TTC
tttcttttttttttttttga

SEQ ID NO: 28313 - DNA, 20 bp, Artificial Sequence
  Description of Artificial Sequence: Synthetic oligonucleotide
  Target: FXN; (-) strand; PAM type: YTN; PAM sequence: TTT
ctttcttttttttttttttg

SEQ ID NO: 28314 - DNA, 20 bp, Artificial Sequence
  Description of Artificial Sequence: Synthetic oligonucleotide
  Target: FXN; (-) strand; PAM type: YTN; PAM sequence: TTT
tctttctttttttttttttt

SEQ ID NO: 28315 - DNA, 20 bp, Artificial Sequence
  Description of Artificial Sequence: Synthetic oligonucleotide
  Target: FXN; (-) strand; PAM type: YTN; PAM sequence: CTG
ggccgttttctttctttttt

SEQ ID NO: 28316 - DNA, 20 bp, Artificial Sequence
  Description of Artificial Sequence: Synthetic oligonucleotide
  Target: FXN; (-) strand; PAM type: YTN; PAM sequence: TTC
ctgggccgttttctttcttt

SEQ ID NO: 28317 - DNA, 20 bp, Artificial Sequence
  Description of Artificial Sequence: Synthetic oligonucleotide
  Target: FXN; (-) strand; PAM type: YTN; PAM sequence: CTT
cctgggccgttttctttctt

SEQ ID NO: 28318 - DNA, 20 bp, Artificial Sequence
  Description of Artificial Sequence: Synthetic oligonucleotide
  Target: FXN; (-) strand; PAM type: YTN; PAM sequence: CTC
cagccttcctgggccgtttt

SEQ ID NO: 28319 - DNA, 20 bp, Artificial Sequence
  Description of Artificial Sequence: Synthetic oligonucleotide
  Target: FXN; (-) strand; PAM type: YTN; PAM sequence: CTC
aatggacacggcggccctcc

SEQ ID NO: 28320 - DNA, 20 bp, Artificial Sequence
  Description of Artificial Sequence: Synthetic oligonucleotide
  Target: FXN; (-) strand; PAM type: YTN; PAM sequence: CTC
tcaatggacacggcggccct

SEQ ID NO: 28321 - DNA, 20 bp, Artificial Sequence
  Description of Artificial Sequence: Synthetic oligonucleotide
  Target: FXN; (-) strand; PAM type: YTN; PAM sequence: CTC
tctcaatggacacggcggcc

SEQ ID NO: 28322 - DNA, 20 bp, Artificial Sequence
  Description of Artificial Sequence: Synthetic oligonucleotide
  Target: FXN; (-) strand; PAM type: YTN; PAM sequence: CTG
gagcactctctcaatggaca

SEQ ID NO: 28323 - DNA, 20 bp, Artificial Sequence
  Description of Artificial Sequence: Synthetic oligonucleotide
  Target: FXN; (-) strand; PAM type: YTN; PAM sequence: TTG
gagtgcctggagcactctct

SEQ ID NO: 28324 - DNA, 20 bp, Artificial Sequence
  Description of Artificial Sequence: Synthetic oligonucleotide
  Target: FXN; (-) strand; PAM type: YTN; PAM sequence: TTT
ggagtgcctggagcactctc

SEQ ID NO: 28325 - DNA, 20 bp, Artificial Sequence
  Description of Artificial Sequence: Synthetic oligonucleotide
  Target: FXN; (-) strand; PAM type: YTN; PAM sequence: TTT
tggagtgcctggagcactct

SEQ ID NO: 28326 - DNA, 20 bp, Artificial Sequence
  Description of Artificial Sequence: Synthetic oligonucleotide
  Target: FXN; (-) strand; PAM type: YTN; PAM sequence: TTT
ttggagtgcctggagcactc

SEQ ID NO: 28327 - DNA, 20 bp, Artificial Sequence
  Description of Artificial Sequence: Synthetic oligonucleotide
  Target: FXN; (-) strand; PAM type: YTN; PAM sequence: CTT
tttggagtgcctggagcact

SEQ ID NO: 28328 - DNA, 20 bp, Artificial Sequence
  Description of Artificial Sequence: Synthetic oligonucleotide
  Target: FXN; (-) strand; PAM type: YTN; PAM sequence: TTC
tttttggagtgcctggagca

SEQ ID NO: 28329 - DNA, 20 bp, Artificial Sequence
  Description of Artificial Sequence: Synthetic oligonucleotide
  Target: FXN; (-) strand; PAM type: YTN; PAM sequence: TTT
ctttttggagtgcctggagc

SEQ ID NO: 28330 - DNA, 20 bp, Artificial Sequence
  Description of Artificial Sequence: Synthetic oligonucleotide
  Target: FXN; (-) strand; PAM type: YTN; PAM sequence: TTT
tctttttggagtgcctggag

SEQ ID NO: 28331 - DNA, 20 bp, Artificial Sequence
  Description of Artificial Sequence: Synthetic oligonucleotide
  Target: FXN; (-) strand; PAM type: YTN; PAM sequence: TTG
tggtcattttctttttggag

SEQ ID NO: 28332 - DNA, 20 bp, Artificial Sequence
  Description of Artificial Sequence: Synthetic oligonucleotide
  Target: FXN; (-) strand; PAM type: YTN; PAM sequence: TTC
ccattgtggtcattttcttt

SEQ ID NO: 28333 - DNA, 20 bp, Artificial Sequence
  Description of Artificial Sequence: Synthetic oligonucleotide
  Target: FXN; (-) strand; PAM type: YTN; PAM sequence: CTT
cccattgtggtcattttctt

SEQ ID NO: 28334 - DNA, 20 bp, Artificial Sequence
  Description of Artificial Sequence: Synthetic oligonucleotide
  Target: FXN; (-) strand; PAM type: YTN; PAM sequence: TTC
ttcccattgtggtcattttc

SEQ ID NO: 28335 - DNA, 20 bp, Artificial Sequence
  Description of Artificial Sequence: Synthetic oligonucleotide
  Target: FXN; (-) strand; PAM type: YTN; PAM sequence: TTT
cttcccattgtggtcatttt

SEQ ID NO: 28336 - DNA, 20 bp, Artificial Sequence
  Description of Artificial Sequence: Synthetic oligonucleotide
  Target: FXN; (-) strand; PAM type: YTN; PAM sequence: CTG
gtttcttcccattgtggtca

SEQ ID NO: 28337 - DNA, 20 bp, Artificial Sequence
  Description of Artificial Sequence: Synthetic oligonucleotide
  Target: FXN; (-) strand; PAM type: YTN; PAM sequence: CTC
atggtcagctggtttcttcc

SEQ ID NO: 28338 - DNA, 20 bp, Artificial Sequence
  Description of Artificial Sequence: Synthetic oligonucleotide
  Target: FXN; (-) strand; PAM type: YTN; PAM sequence: TTG
gtctcatggtcagctggttt

SEQ ID NO: 28339 - DNA, 20 bp, Artificial Sequence
  Description of Artificial Sequence: Synthetic oligonucleotide
  Target: FXN; (-) strand; PAM type: YTN; PAM sequence: CTT
ggtctcatggtcagctggtt

SEQ ID NO: 28340 - DNA, 20 bp, Artificial Sequence
  Description of Artificial Sequence: Synthetic oligonucleotide
  Target: FXN; (-) strand; PAM type: YTN; PAM sequence: TTG
gaacttggtctcatggtcag

SEQ ID NO: 28341 - DNA, 20 bp, Artificial Sequence
  Description of Artificial Sequence: Synthetic oligonucleotide
  Target: FXN; (-) strand; PAM type: YTN; PAM sequence: TTG
taaaaggttggaacttggtc

SEQ ID NO: 28342 - DNA, 20 bp, Artificial Sequence
  Description of Artificial Sequence: Synthetic oligonucleotide
  Target: FXN; (-) strand; PAM type: YTN; PAM sequence: CTT
gtaaaaggttggaacttggt

SEQ ID NO: 28343 - DNA, 20 bp, Artificial Sequence
  Description of Artificial Sequence: Synthetic oligonucleotide
  Target: FXN; (-) strand; PAM type: YTN; PAM sequence: CTG
tgggcggggcgccaggagcc

SEQ ID NO: 28344 - DNA, 20 bp, Artificial Sequence
  Description of Artificial Sequence: Synthetic oligonucleotide
  Target: FXN; (-) strand; PAM type: YTN; PAM sequence: CTG
tcagctgtgggcggggcgcc

SEQ ID NO: 28345 - DNA, 20 bp, Artificial Sequence
  Description of Artificial Sequence: Synthetic oligonucleotide
  Target: FXN; (-) strand; PAM type: YTN; PAM sequence: CTG
agcccctgtcagctgtgggc

SEQ ID NO: 28346 - DNA, 20 bp, Artificial Sequence
  Description of Artificial Sequence: Synthetic oligonucleotide
  Target: FXN; (-) strand; PAM type: YTN; PAM sequence: TTC
tgagcccctgtcagctgtgg

SEQ ID NO: 28347 - DNA, 20 bp, Artificial Sequence
  Description of Artificial Sequence: Synthetic oligonucleotide
  Target: FXN; (-) strand; PAM type: YTN; PAM sequence: CTT
ctgagcccctgtcagctgtg

SEQ ID NO: 28348 - DNA, 20 bp, Artificial Sequence
  Description of Artificial Sequence: Synthetic oligonucleotide
  Target: FXN; (-) strand; PAM type: YTN; PAM sequence: CTA
gcacttctgagcccctgtca

SEQ ID NO: 28349 - DNA, 20 bp, Artificial Sequence
  Description of Artificial Sequence: Synthetic oligonucleotide
  Target: FXN; (-) strand; PAM type: YTN; PAM sequence: CTG
gtggcccatggtccccctag

SEQ ID NO: 28350 - DNA, 20 bp, Artificial Sequence
  Description of Artificial Sequence: Synthetic oligonucleotide
  Target: FXN; (-) strand; PAM type: YTN; PAM sequence: CTG
gtggccctggtggcccatgg

SEQ ID NO: 28351 - DNA, 20 bp, Artificial Sequence
  Description of Artificial Sequence: Synthetic oligonucleotide
  Target: FXN; (-) strand; PAM type: YTN; PAM sequence: CTC
ctggtggccctggtggccca

SEQ ID NO: 28352 - DNA, 20 bp, Artificial Sequence
  Description of Artificial Sequence: Synthetic oligonucleotide
  Target: FXN; (-) strand; PAM type: YTN; PAM sequence: CTC
cctcctggtggccctggtgg

SEQ ID NO: 28353 - DNA, 20 bp, Artificial Sequence
  Description of Artificial Sequence: Synthetic oligonucleotide
  Target: FXN; (-) strand; PAM type: YTN; PAM sequence: CTG
cctccctcctggtggccctg

SEQ ID NO: 28354 - DNA, 20 bp, Artificial Sequence
  Description of Artificial Sequence: Synthetic oligonucleotide
  Target: FXN; (-) strand; PAM type: YTN; PAM sequence: TTA
cctgcctccctcctggtggc

SEQ ID NO: 28355 - DNA, 20 bp, Artificial Sequence
  Description of Artificial Sequence: Synthetic oligonucleotide
  Target: FXN; (-) strand; PAM type: YTN; PAM sequence: CTC
gcatcgttacctgcctccct

SEQ ID NO: 28356 - DNA, 20 bp, Artificial Sequence
  Description of Artificial Sequence: Synthetic oligonucleotide
  Target: FXN; (-) strand; PAM type: YTN; PAM sequence: CTG
catccaagccctcgcatcgt

SEQ ID NO: 28357 - DNA, 20 bp, Artificial Sequence
  Description of Artificial Sequence: Synthetic oligonucleotide
  Target: FXN; (-) strand; PAM type: YTN; PAM sequence: TTC
tgcatccaagccctcgcatc

SEQ ID NO: 28358 - DNA, 20 bp, Artificial Sequence
  Description of Artificial Sequence: Synthetic oligonucleotide
  Target: FXN; (-) strand; PAM type: YTN; PAM sequence: CTG
gtgttctgcatccaagccct

SEQ ID NO: 28359 - DNA, 20 bp, Artificial Sequence
  Description of Artificial Sequence: Synthetic oligonucleotide
  Target: FXN; (-) strand; PAM type: YTN; PAM sequence: TTC
aggacccaggtacagggaaa

SEQ ID NO: 28360 - DNA, 20 bp, Artificial Sequence
  Description of Artificial Sequence: Synthetic oligonucleotide
  Target: FXN; (-) strand; PAM type: YTN; PAM sequence: CTG
ggcattcaggacccaggtac

SEQ ID NO: 28361 - DNA, 20 bp, Artificial Sequence
  Description of Artificial Sequence: Synthetic oligonucleotide
  Target: FXN; (-) strand; PAM type: YTN; PAM sequence: CTC
tgggcattcaggacccaggt

SEQ ID NO: 28362 - DNA, 20 bp, Artificial Sequence
  Description of Artificial Sequence: Synthetic oligonucleotide
  Target: FXN; (-) strand; PAM type: YTN; PAM sequence: CTG
agcctctgggcattcaggac

SEQ ID NO: 28363 - DNA, 20 bp, Artificial Sequence
  Description of Artificial Sequence: Synthetic oligonucleotide
  Target: FXN; (-) strand; PAM type: YTN; PAM sequence: TTC
cctgagcctctgggcattca

SEQ ID NO: 28364 - DNA, 20 bp, Artificial Sequence
  Description of Artificial Sequence: Synthetic oligonucleotide
  Target: FXN; (-) strand; PAM type: YTN; PAM sequence: TTT
ccctgagcctctgggcattc

SEQ ID NO: 28365 - DNA, 20 bp, Artificial Sequence
  Description of Artificial Sequence: Synthetic oligonucleotide
  Target: FXN; (-) strand; PAM type: YTN; PAM sequence: CTG
gtgtttccctgagcctctgg

SEQ ID NO: 28366 - DNA, 20 bp, Artificial Sequence
  Description of Artificial Sequence: Synthetic oligonucleotide
  Target: FXN; (-) strand; PAM type: YTN; PAM sequence: CTG
gctggtgtttccctgagcct

SEQ ID NO: 28367 - DNA, 20 bp, Artificial Sequence
  Description of Artificial Sequence: Synthetic oligonucleotide
  Target: FXN; (-) strand; PAM type: YTN; PAM sequence: TTA
aaggcagcagcactggctgg

SEQ ID NO: 28368 - DNA, 20 bp, Artificial Sequence
  Description of Artificial Sequence: Synthetic oligonucleotide
  Target: FXN; (-) strand; PAM type: YTN; PAM sequence: TTT
aaaggcagcagcactggctg

SEQ ID NO: 28369 - DNA, 20 bp, Artificial Sequence
  Description of Artificial Sequence: Synthetic oligonucleotide
  Target: FXN; (-) strand; PAM type: YTN; PAM sequence: CTT
taaaggcagcagcactggct

SEQ ID NO: 28370 - DNA, 20 bp, Artificial Sequence
  Description of Artificial Sequence: Synthetic oligonucleotide
  Target: FXN; (-) strand; PAM type: YTN; PAM sequence: TTA
acaagagatcagtcaaaagt

SEQ ID NO: 28371 - DNA, 20 bp, Artificial Sequence
  Description of Artificial Sequence: Synthetic oligonucleotide
  Target: FXN; (-) strand; PAM type: YTN; PAM sequence: CTA
aattaacaagagatcagtca

SEQ ID NO: 28372 - DNA, 20 bp, Artificial Sequence
  Description of Artificial Sequence: Synthetic oligonucleotide
  Target: FXN; (-) strand; PAM type: YTN; PAM sequence: TTG
ctaaattaacaagagatcag

SEQ ID NO: 28373 - DNA, 20 bp, Artificial Sequence
  Description of Artificial Sequence: Synthetic oligonucleotide
  Target: FXN; (-) strand; PAM type: YTN; PAM sequence: CTG
cagcatcaaccaataacagt

SEQ ID NO: 28374 - DNA, 20 bp, Artificial Sequence
  Description of Artificial Sequence: Synthetic oligonucleotide
  Target: FXN; (-) strand; PAM type: YTN; PAM sequence: TTC
aataagagcaactgcagcat

SEQ ID NO: 28375 - DNA, 20 bp, Artificial Sequence
  Description of Artificial Sequence: Synthetic oligonucleotide
  Target: FXN; (-) strand; PAM type: YTN; PAM sequence: CTT
caataagagcaactgcagca

SEQ ID NO: 28376 - DNA, 20 bp, Artificial Sequence
  Description of Artificial Sequence: Synthetic oligonucleotide
  Target: FXN; (-) strand; PAM type: YTN; PAM sequence: CTA
tcaatcaaacttcaataaga

SEQ ID NO: 28377 - DNA, 20 bp, Artificial Sequence
  Description of Artificial Sequence: Synthetic oligonucleotide
  Target: FXN; (-) strand; PAM type: YTN; PAM sequence: CTA
atgctatcaatcaaacttca

SEQ ID NO: 28378 - DNA, 20 bp, Artificial Sequence
  Description of Artificial Sequence: Synthetic oligonucleotide
  Target: FXN; (-) strand; PAM type: YTN; PAM sequence: TTA
ccatcctaatgctatcaatc

SEQ ID NO: 28379 - DNA, 20 bp, Artificial Sequence
  Description of Artificial Sequence: Synthetic oligonucleotide
  Target: FXN; (-) strand; PAM type: YTN; PAM sequence: CTT
accatcctaatgctatcaat

SEQ ID NO: 28380 - DNA, 20 bp, Artificial Sequence
  Description of Artificial Sequence: Synthetic oligonucleotide
  Target: FXN; (-) strand; PAM type: YTN; PAM sequence: TTG
aaaaatagtgccttaccatc

SEQ ID NO: 28381 - DNA, 20 bp, Artificial Sequence
  Description of Artificial Sequence: Synthetic oligonucleotide
  Target: FXN; (-) strand; PAM type: YTN; PAM sequence: TTT
gaaaaatagtgccttaccat

SEQ ID NO: 28382 - DNA, 20 bp, Artificial Sequence
  Description of Artificial Sequence: Synthetic oligonucleotide
  Target: FXN; (-) strand; PAM type: YTN; PAM sequence: TTA
tttgaaaaatagtgccttac

SEQ ID NO: 28383 - DNA, 20 bp, Artificial Sequence
  Description of Artificial Sequence: Synthetic oligonucleotide
  Target: FXN; (-) strand; PAM type: YTN; PAM sequence: TTT
atttgaaaaatagtgcctta

SEQ ID NO: 28384 - DNA, 20 bp, Artificial Sequence
  Description of Artificial Sequence: Synthetic oligonucleotide
  Target: FXN; (-) strand; PAM type: YTN; PAM sequence: CTT
tatttgaaaaatagtgcctt

SEQ ID NO: 28385 - DNA, 20 bp, Artificial Sequence
  Description of Artificial Sequence: Synthetic oligonucleotide
  Target: FXN; (-) strand; PAM type: YTN; PAM sequence: TTA
aacaacctttatttgaaaaa

SEQ ID NO: 28386 - DNA, 20 bp, Artificial Sequence
  Description of Artificial Sequence: Synthetic oligonucleotide
  Target: FXN; (-) strand; PAM type: YTN; PAM sequence: TTA
tattaaacaacctttatttg

SEQ ID NO: 28387 - DNA, 20 bp, Artificial Sequence
  Description of Artificial Sequence: Synthetic oligonucleotide
  Target: FXN; (-) strand; PAM type: YTN; PAM sequence: TTT
atattaaacaacctttattt

SEQ ID NO: 28388 - DNA, 20 bp, Artificial Sequence
  Description of Artificial Sequence: Synthetic oligonucleotide
  Target: FXN; (-) strand; PAM type: YTN; PAM sequence: TTT
tatattaaacaacctttatt

SEQ ID NO: 28389 - DNA, 20 bp, Artificial Sequence
  Description of Artificial Sequence: Synthetic oligonucleotide
  Target: FXN; (-) strand; PAM type: YTN; PAM sequence: TTT
ttatattaaacaacctttat

SEQ ID NO: 28390 - DNA, 20 bp, Artificial Sequence
  Description of Artificial Sequence: Synthetic oligonucleotide
  Target: FXN; (-) strand; PAM type: YTN; PAM sequence: TTT
tttatattaaacaaccttta

SEQ ID NO: 28391 - DNA, 20 bp, Artificial Sequence
  Description of Artificial Sequence: Synthetic oligonucleotide
  Target: FXN; (-) strand; PAM type: YTN; PAM sequence: TTT
ttttatattaaacaaccttt

SEQ ID NO: 28392 - DNA, 20 bp, Artificial Sequence
  Description of Artificial Sequence: Synthetic oligonucleotide
  Target: FXN; (-) strand; PAM type: YTN; PAM sequence: TTT
tttttatattaaacaacctt

SEQ ID NO: 28393 - DNA, 20 bp, Artificial Sequence
  Description of Artificial Sequence: Synthetic oligonucleotide
  Target: FXN; (-) strand; PAM type: YTN; PAM sequence: CTG
agagaaaaaaaaacaaaatt

SEQ ID NO: 28394 - DNA, 20 bp, Artificial Sequence
  Description of Artificial Sequence: Synthetic oligonucleotide
  Target: FXN; (-) strand; PAM type: YTN; PAM sequence: TTG
aaccaatgtgaaaggctgag

SEQ ID NO: 28395 - DNA, 20 bp, Artificial Sequence
  Description of Artificial Sequence: Synthetic oligonucleotide
  Target: FXN; (-) strand; PAM type: YTN; PAM sequence: TTT
gaaccaatgtgaaaggctga

SEQ ID NO: 28396 - DNA, 20 bp, Artificial Sequence
  Description of Artificial Sequence: Synthetic oligonucleotide
  Target: FXN; (-) strand; PAM type: YTN; PAM sequence: TTT
tgaaccaatgtgaaaggctg

SEQ ID NO: 28397 - DNA, 20 bp, Artificial Sequence
  Description of Artificial Sequence: Synthetic oligonucleotide
  Target: FXN; (-) strand; PAM type: YTN; PAM sequence: TTA
agaaaaaaaaaacaaaacaa

SEQ ID NO: 28398 - DNA, 20 bp, Artificial Sequence
  Description of Artificial Sequence: Synthetic oligonucleotide
  Target: FXN; (-) strand; PAM type: YTN; PAM sequence: TTA
aaaataaataaaattaagaa

SEQ ID NO: 28399 - DNA, 20 bp, Artificial Sequence
  Description of Artificial Sequence: Synthetic oligonucleotide
  Target: FXN; (-) strand; PAM type: YTN; PAM sequence: TTA
attaaaaataaataaaatta

SEQ ID NO: 28400 - DNA, 20 bp, Artificial Sequence
  Description of Artificial Sequence: Synthetic oligonucleotide
  Target: FXN; (-) strand; PAM type: YTN; PAM sequence: TTT
aattaaaaataaataaaatt

SEQ ID NO: 28401 - DNA, 20 bp, Artificial Sequence
  Description of Artificial Sequence: Synthetic oligonucleotide
  Target: FXN; (-) strand; PAM type: YTN; PAM sequence: TTT
taattaaaaataaataaaat

SEQ ID NO: 28402 - DNA, 20 bp, Artificial Sequence
  Description of Artificial Sequence: Synthetic oligonucleotide
  Target: FXN; (-) strand; PAM type: YTN; PAM sequence: TTT
ttaattaaaaataaataaaa

SEQ ID NO: 28403 - DNA, 20 bp, Artificial Sequence
  Description of Artificial Sequence: Synthetic oligonucleotide
  Target: FXN; (-) strand; PAM type: YTN; PAM sequence: TTA
tttttaattaaaaataaata

SEQ ID NO: 28404 - DNA, 20 bp, Artificial Sequence
  Description of Artificial Sequence: Synthetic oligonucleotide
  Target: FXN; (-) strand; PAM type: YTN; PAM sequence: TTG
acaaaaaaaattatttttaa

SEQ ID NO: 28405 - DNA, 20 bp, Artificial Sequence
  Description of Artificial Sequence: Synthetic oligonucleotide
  Target: FXN; (-) strand; PAM type: YTN; PAM sequence: CTA
ggcaacaaagtgagacccca

SEQ ID NO: 28406 - DNA, 20 bp, Artificial Sequence
  Description of Artificial Sequence: Synthetic oligonucleotide
  Target: FXN; (-) strand; PAM type: YTN; PAM sequence: TTC
agaccaacctaggcaacaaa

SEQ ID NO: 28407 - DNA, 20 bp, Artificial Sequence
  Description of Artificial Sequence: Synthetic oligonucleotide
  Target: FXN; (-) strand; PAM type: YTN; PAM sequence: TTT
cagaccaacctaggcaacaa

SEQ ID NO: 28408 - DNA, 20 bp, Artificial Sequence
  Description of Artificial Sequence: Synthetic oligonucleotide
  Target: FXN; (-) strand; PAM type: YTN; PAM sequence: TTG
aagccacgagtttcagacca

SEQ ID NO: 28409 - DNA, 20 bp, Artificial Sequence
  Description of Artificial Sequence: Synthetic oligonucleotide
  Target: FXN; (-) strand; PAM type: YTN; PAM sequence: CTT
gaagccacgagtttcagacc

SEQ ID NO: 28410 - DNA, 20 bp, Artificial Sequence
  Description of Artificial Sequence: Synthetic oligonucleotide
  Target: FXN; (-) strand; PAM type: YTN; PAM sequence: TTG
cttgaagccacgagtttcag

SEQ ID NO: 28411 - DNA, 20 bp, Artificial Sequence
  Description of Artificial Sequence: Synthetic oligonucleotide
  Target: FXN; (-) strand; PAM type: YTN; PAM sequence: CTG
atgtgggaggattgcttgaa

SEQ ID NO: 28412 - DNA, 20 bp, Artificial Sequence
  Description of Artificial Sequence: Synthetic oligonucleotide
  Target: FXN; (-) strand; PAM type: YTN; PAM sequence: TTG
ggaggctgatgtgggaggat

SEQ ID NO: 28413 - DNA, 20 bp, Artificial Sequence
  Description of Artificial Sequence: Synthetic oligonucleotide
  Target: FXN; (-) strand; PAM type: YTN; PAM sequence: TTT
gggaggctgatgtgggagga

SEQ ID NO: 28414 - DNA, 20 bp, Artificial Sequence
  Description of Artificial Sequence: Synthetic oligonucleotide
  Target: FXN; (-) strand; PAM type: YTN; PAM sequence: CTT
tgggaggctgatgtgggagg

SEQ ID NO: 28415 - DNA, 20 bp, Artificial Sequence
  Description of Artificial Sequence: Synthetic oligonucleotide
  Target: FXN; (-) strand; PAM type: YTN; PAM sequence: CTC
acacccataaccccagcact

SEQ ID NO: 28416 - DNA, 20 bp, Artificial Sequence
  Description of Artificial Sequence: Synthetic oligonucleotide
  Target: FXN; (-) strand; PAM type: YTN; PAM sequence: CTG
cagtggctcacacccataac

SEQ ID NO: 28417 - DNA, 20 bp, Artificial Sequence
  Description of Artificial Sequence: Synthetic oligonucleotide
  Target: FXN; (-) strand; PAM type: YTN; PAM sequence: CTG
ctgcagtggctcacacccat

SEQ ID NO: 28418 - DNA, 20 bp, Artificial Sequence
  Description of Artificial Sequence: Synthetic oligonucleotide
  Target: FXN; (-) strand; PAM type: YTN; PAM sequence: TTA
aaaaaaacaaacaaacaaaa

SEQ ID NO: 28419 - DNA, 20 bp, Artificial Sequence
  Description of Artificial Sequence: Synthetic oligonucleotide
  Target: FXN; (-) strand; PAM type: YTN; PAM sequence: TTG
tcaaattaaaaaaaacaaac

SEQ ID NO: 28420 - DNA, 20 bp, Artificial Sequence
  Description of Artificial Sequence: Synthetic oligonucleotide
  Target: FXN; (-) strand; PAM type: YTN; PAM sequence: CTT
gtcaaattaaaaaaaacaaa

SEQ ID NO: 28421 - DNA, 20 bp, Artificial Sequence
  Description of Artificial Sequence: Synthetic oligonucleotide
  Target: FXN; (-) strand; PAM type: YTN; PAM sequence: CTG
aaaacttgtcaaattaaaaa

SEQ ID NO: 28422 - DNA, 20 bp, Artificial Sequence
  Description of Artificial Sequence: Synthetic oligonucleotide
  Target: FXN; (-) strand; PAM type: YTN; PAM sequence: TTC
acaggacctgaaaacttgtc

SEQ ID NO: 28423 - DNA, 20 bp, Artificial Sequence
  Description of Artificial Sequence: Synthetic oligonucleotide
  Target: FXN; (-) strand; PAM type: YTN; PAM sequence: TTT
cacaggacctgaaaacttgt

SEQ ID NO: 28424 - DNA, 20 bp, Artificial Sequence
  Description of Artificial Sequence: Synthetic oligonucleotide
  Target: FXN; (-) strand; PAM type: YTN; PAM sequence: CTG
atttcacaggacctgaaaac

SEQ ID NO: 28425 - DNA, 20 bp, Artificial Sequence
  Description of Artificial Sequence: Synthetic oligonucleotide
  Target: FXN; (-) strand; PAM type: YTN; PAM sequence: CTG
ctgatttcacaggacctgaa

SEQ ID NO: 28426 - DNA, 20 bp, Artificial Sequence
  Description of Artificial Sequence: Synthetic oligonucleotide
  Target: FXN; (-) strand; PAM type: YTN; PAM sequence: CTC
agggtgcgcaaggtgggagg

SEQ ID NO: 28427 - DNA, 20 bp, Artificial Sequence
  Description of Artificial Sequence: Synthetic oligonucleotide
  Target: FXN; (-) strand; PAM type: YTN; PAM sequence: CTC
ctcagggtgcgcaaggtggg

SEQ ID NO: 28428 - DNA, 20 bp, Artificial Sequence
  Description of Artificial Sequence: Synthetic oligonucleotide
  Target: FXN; (-) strand; PAM type: YTN; PAM sequence: CTG
caacctcctcagggtgcgca

SEQ ID NO: 28429 - DNA, 20 bp, Artificial Sequence
  Description of Artificial Sequence: Synthetic oligonucleotide
  Target: FXN; (-) strand; PAM type: YTN; PAM sequence: TTC
tgcaacctcctcagggtgcg

SEQ ID NO: 28430 - DNA, 20 bp, Artificial Sequence
  Description of Artificial Sequence: Synthetic oligonucleotide
  Target: FXN; (-) strand; PAM type: YTN; PAM sequence: TTA
ttctgcaacctcctcagggt

SEQ ID NO: 28431 - DNA, 20 bp, Artificial Sequence
  Description of Artificial Sequence: Synthetic oligonucleotide
  Target: FXN; (-) strand; PAM type: YTN; PAM sequence: TTT
attctgcaacctcctcaggg

SEQ ID NO: 28432 - DNA, 20 bp, Artificial Sequence
  Description of Artificial Sequence: Synthetic oligonucleotide
  Target: FXN; (-) strand; PAM type: YTN; PAM sequence: CTT
tattctgcaacctcctcagg

SEQ ID NO: 28433 - DNA, 20 bp, Artificial Sequence
  Description of Artificial Sequence: Synthetic oligonucleotide
  Target: FXN; (-) strand; PAM type: YTN; PAM sequence: CTC
ctttattctgcaacctcctc

SEQ ID NO: 28434 - DNA, 20 bp, Artificial Sequence
  Description of Artificial Sequence: Synthetic oligonucleotide
  Target: FXN; (-) strand; PAM type: YTN; PAM sequence: TTC
tcctttattctgcaacctcc

SEQ ID NO: 28435 - DNA, 20 bp, Artificial Sequence
  Description of Artificial Sequence: Synthetic oligonucleotide
  Target: FXN; (-) strand; PAM type: YTN; PAM sequence: CTA
gaattctcctttattctgca

SEQ ID NO: 28436 - DNA, 20 bp, Artificial Sequence
  Description of Artificial Sequence: Synthetic oligonucleotide
  Target: FXN; (-) strand; PAM type: YTN; PAM sequence: CTG
atgcccacgtgtccctagaa

SEQ ID NO: 28437 - DNA, 20 bp, Artificial Sequence
  Description of Artificial Sequence: Synthetic oligonucleotide
  Target: FXN; (-) strand; PAM type: YTN; PAM sequence: CTG
agcacaggcactgatgccca

SEQ ID NO: 28438 - DNA, 20 bp, Artificial Sequence
  Description of Artificial Sequence: Synthetic oligonucleotide
  Target: FXN; (-) strand; PAM type: YTN; PAM sequence: CTC
tgagcacaggcactgatgcc

SEQ ID NO: 28439 - DNA, 20 bp, Artificial Sequence
  Description of Artificial Sequence: Synthetic oligonucleotide
  Target: FXN; (-) strand; PAM type: YTN; PAM sequence: CTG
aggtgctctgagcacaggca

SEQ ID NO: 28440 - DNA, 20 bp, Artificial Sequence
  Description of Artificial Sequence: Synthetic oligonucleotide
  Target: FXN; (-) strand; PAM type: YTN; PAM sequence: CTG
cctgaggtgctctgagcaca

SEQ ID NO: 28441 - DNA, 20 bp, Artificial Sequence
  Description of Artificial Sequence: Synthetic oligonucleotide
  Target: FXN; (-) strand; PAM type: YTN; PAM sequence: CTC
cacactgcctgaggtgctct

SEQ ID NO: 28442 - DNA, 20 bp, Artificial Sequence
  Description of Artificial Sequence: Synthetic oligonucleotide
  Target: FXN; (-) strand; PAM type: YTN; PAM sequence: CTA
gacccctccacactgcctga

SEQ ID NO: 28443 - DNA, 20 bp, Artificial Sequence
  Description of Artificial Sequence: Synthetic oligonucleotide
  Target: FXN; (-) strand; PAM type: YTN; PAM sequence: CTC
tagacccctccacactgcct

SEQ ID NO: 28444 - DNA, 20 bp, Artificial Sequence
  Description of Artificial Sequence: Synthetic oligonucleotide
  Target: FXN; (-) strand; PAM type: YTN; PAM sequence: CTG
agtaacctctagacccctcc

SEQ ID NO: 28445 - DNA, 20 bp, Artificial Sequence
  Description of Artificial Sequence: Synthetic oligonucleotide
  Target: FXN; (-) strand; PAM type: YTN; PAM sequence: TTG
ccaggcagagcctgagtaac

SEQ ID NO: 28446 - DNA, 20 bp, Artificial Sequence
  Description of Artificial Sequence: Synthetic oligonucleotide
  Target: FXN; (-) strand; PAM type: YTN; PAM sequence: CTA
tcgggttgccaggcagagcc

SEQ ID NO: 28447 - DNA, 20 bp, Artificial Sequence
  Description of Artificial Sequence: Synthetic oligonucleotide
  Target: FXN; (-) strand; PAM type: YTN; PAM sequence: CTG
ctatcgggttgccaggcaga

SEQ ID NO: 28448 - DNA, 20 bp, Artificial Sequence
  Description of Artificial Sequence: Synthetic oligonucleotide
  Target: FXN; (-) strand; PAM type: YTN; PAM sequence: CTG
atactgctatcgggttgcca

SEQ ID NO: 28449 - DNA, 20 bp, Artificial Sequence
  Description of Artificial Sequence: Synthetic oligonucleotide
  Target: FXN; (-) strand; PAM type: YTN; PAM sequence: CTC
tgatactgctatcgggttgc

SEQ ID NO: 28450 - DNA, 20 bp, Artificial Sequence
  Description of Artificial Sequence: Synthetic oligonucleotide
  Target: FXN; (-) strand; PAM type: YTN; PAM sequence: CTA
tactctgatactgctatcgg

SEQ ID NO: 28451 - DNA, 20 bp, Artificial Sequence
  Description of Artificial Sequence: Synthetic oligonucleotide
  Target: FXN; (-) strand; PAM type: YTN; PAM sequence: TTG
gccctatactctgatactgc

SEQ ID NO: 28452 - DNA, 20 bp, Artificial Sequence
  Description of Artificial Sequence: Synthetic oligonucleotide
  Target: FXN; (-) strand; PAM type: YTN; PAM sequence: CTT
ggccctatactctgatactg

SEQ ID NO: 28453 - DNA, 20 bp, Artificial Sequence
  Description of Artificial Sequence: Synthetic oligonucleotide
  Target: FXN; (-) strand; PAM type: YTN; PAM sequence: CTA
ataaaccacaccaagcccaa

SEQ ID NO: 28454 - DNA, 20 bp, Artificial Sequence
  Description of Artificial Sequence: Synthetic oligonucleotide
  Target: FXN; (-) strand; PAM type: YTN; PAM sequence: TTC
ccagtatggagataaaaatg

SEQ ID NO: 28455 - DNA, 20 bp, Artificial Sequence
  Description of Artificial Sequence: Synthetic oligonucleotide
  Target: FXN; (-) strand; PAM type: YTN; PAM sequence: CTG
ttcccagtatggagataaaa

SEQ ID NO: 28456 - DNA, 20 bp, Artificial Sequence
  Description of Artificial Sequence: Synthetic oligonucleotide
  Target: FXN; (-) strand; PAM type: YTN; PAM sequence: TTG
aacctgttcccagtatggag

SEQ ID NO: 28457 - DNA, 20 bp, Artificial Sequence
  Description of Artificial Sequence: Synthetic oligonucleotide
  Target: FXN; (-) strand; PAM type: YTN; PAM sequence: CTT
gaacctgttcccagtatgga

SEQ ID NO: 28458 - DNA, 20 bp, Artificial Sequence
  Description of Artificial Sequence: Synthetic oligonucleotide
  Target: FXN; (-) strand; PAM type: YTN; PAM sequence: CTG
gggcttgaacctgttcccag

SEQ ID NO: 28459 - DNA, 20 bp, Artificial Sequence
  Description of Artificial Sequence: Synthetic oligonucleotide
  Target: FXN; (-) strand; PAM type: YTN; PAM sequence: TTA
tcaaccaaatgctggggctt

SEQ ID NO: 28460 - DNA, 20 bp, Artificial Sequence
  Description of Artificial Sequence: Synthetic oligonucleotide
  Target: FXN; (-) strand; PAM type: YTN; PAM sequence: CTG
cattatcaaccaaatgctgg

SEQ ID NO: 28461 - DNA, 20 bp, Artificial Sequence
  Description of Artificial Sequence: Synthetic oligonucleotide
  Target: FXN; (-) strand; PAM type: YTN; PAM sequence: TTC
ctgcattatcaaccaaatgc

SEQ ID NO: 28462 - DNA, 20 bp, Artificial Sequence
  Description of Artificial Sequence: Synthetic oligonucleotide
  Target: FXN; (-) strand; PAM type: YTN; PAM sequence: TTG
ggcaataaaagtatcaagga

SEQ ID NO: 28463 - DNA, 20 bp, Artificial Sequence
  Description of Artificial Sequence: Synthetic oligonucleotide
  Target: FXN; (-) strand; PAM type: YTN; PAM sequence: CTT
gggcaataaaagtatcaagg

SEQ ID NO: 28464 - DNA, 20 bp, Artificial Sequence
  Description of Artificial Sequence: Synthetic oligonucleotide
  Target: FXN; (-) strand; PAM type: YTN; PAM sequence: CTA
ggatgaggtcaccaggaagg

SEQ ID NO: 28465 - DNA, 20 bp, Artificial Sequence
  Description of Artificial Sequence: Synthetic oligonucleotide
  Target: FXN; (-) strand; PAM type: YTN; PAM sequence: CTG
aggctaggatgaggtcacca

SEQ ID NO: 28466 - DNA, 20 bp, Artificial Sequence
  Description of Artificial Sequence: Synthetic oligonucleotide
  Target: FXN; (-) strand; PAM type: YTN; PAM sequence: TTC
caaagactgaggctaggatg

SEQ ID NO: 28467 - DNA, 20 bp, Artificial Sequence
  Description of Artificial Sequence: Synthetic oligonucleotide
  Target: FXN; (-) strand; PAM type: YTN; PAM sequence: TTT
ccaaagactgaggctaggat

SEQ ID NO: 28468 - DNA, 20 bp, Artificial Sequence
  Description of Artificial Sequence: Synthetic oligonucleotide
  Target: FXN; (-) strand; PAM type: YTN; PAM sequence: TTT
tccaaagactgaggctagga

SEQ ID NO: 28469 - DNA, 20 bp, Artificial Sequence
  Description of Artificial Sequence: Synthetic oligonucleotide
  Target: FXN; (-) strand; PAM type: YTN; PAM sequence: CTT
ttccaaagactgaggctagg

SEQ ID NO: 28470 - DNA, 20 bp, Artificial Sequence
  Description of Artificial Sequence: Synthetic oligonucleotide
  Target: FXN; (-) strand; PAM type: YTN; PAM sequence: CTC
aaggagggcttttccaaaga

SEQ ID NO: 28471 - DNA, 20 bp, Artificial Sequence
  Description of Artificial Sequence: Synthetic oligonucleotide
  Target: FXN; (-) strand; PAM type: YTN; PAM sequence: CTG
agcactcaaggagggctttt

SEQ ID NO: 28472 - DNA, 20 bp, Artificial Sequence
  Description of Artificial Sequence: Synthetic oligonucleotide
  Target: FXN; (-) strand; PAM type: YTN; PAM sequence: CTG
cctgagcactcaaggagggc

SEQ ID NO: 28473 - DNA, 20 bp, Artificial Sequence
  Description of Artificial Sequence: Synthetic oligonucleotide
  Target: FXN; (-) strand; PAM type: YTN; PAM sequence: CTG
agtctgcctgagcactcaag

SEQ ID NO: 28474 - DNA, 20 bp, Artificial Sequence
  Description of Artificial Sequence: Synthetic oligonucleotide
  Target: FXN; (-) strand; PAM type: YTN; PAM sequence: CTG
atggaggtaagaacagagtg

SEQ ID NO: 28475 - DNA, 20 bp, Artificial Sequence
  Description of Artificial Sequence: Synthetic oligonucleotide
  Target: FXN; (-) strand; PAM type: YTN; PAM sequence: CTA
gtgcatgtggcaccctgatg

SEQ ID NO: 28476 - DNA, 20 bp, Artificial Sequence
  Description of Artificial Sequence: Synthetic oligonucleotide
  Target: FXN; (-) strand; PAM type: YTN; PAM sequence: TTG
gccacggcagcagataacac

SEQ ID NO: 28477 - DNA, 20 bp, Artificial Sequence
  Description of Artificial Sequence: Synthetic oligonucleotide
  Target: FXN; (-) strand; PAM type: YTN; PAM sequence: CTC
atggatgattggccacggca

SEQ ID NO: 28478 - DNA, 20 bp, Artificial Sequence
  Description of Artificial Sequence: Synthetic oligonucleotide
  Target: FXN; (-) strand; PAM type: YTN; PAM sequence: CTC
atggcctcatggatgattgg

SEQ ID NO: 28479 - DNA, 20 bp, Artificial Sequence
  Description of Artificial Sequence: Synthetic oligonucleotide
  Target: FXN; (-) strand; PAM type: YTN; PAM sequence: TTC
ctcatggcctcatggatgat

SEQ ID NO: 28480 - DNA, 20 bp, Artificial Sequence
  Description of Artificial Sequence: Synthetic oligonucleotide
  Target: FXN; (-) strand; PAM type: YTN; PAM sequence: CTT
cctcatggcctcatggatga

SEQ ID NO: 28481 - DNA, 20 bp, Artificial Sequence
  Description of Artificial Sequence: Synthetic oligonucleotide
  Target: FXN; (-) strand; PAM type: YTN; PAM sequence: TTC
cacttcctcatggcctcatg

SEQ ID NO: 28482 - DNA, 20 bp, Artificial Sequence
  Description of Artificial Sequence: Synthetic oligonucleotide
  Target: FXN; (-) strand; PAM type: YTN; PAM sequence: TTA
taccagatgtacattccact

SEQ ID NO: 28483 - DNA, 20 bp, Artificial Sequence
  Description of Artificial Sequence: Synthetic oligonucleotide
  Target: FXN; (-) strand; PAM type: YTN; PAM sequence: CTT
ataccagatgtacattccac

SEQ ID NO: 28484 - DNA, 20 bp, Artificial Sequence
  Description of Artificial Sequence: Synthetic oligonucleotide
  Target: FXN; (-) strand; PAM type: YTN; PAM sequence: TTC
ttataccagatgtacattcc

SEQ ID NO: 28485 - DNA, 20 bp, Artificial Sequence
  Description of Artificial Sequence: Synthetic oligonucleotide
  Target: FXN; (-) strand; PAM type: YTN; PAM sequence: CTT
cttataccagatgtacattc

SEQ ID NO: 28486 - DNA, 20 bp, Artificial Sequence
  Description of Artificial Sequence: Synthetic oligonucleotide
  Target: FXN; (-) strand; PAM type: YTN; PAM sequence: CTG
ccatgtcttcttataccaga

SEQ ID NO: 28487 - DNA, 20 bp, Artificial Sequence
  Description of Artificial Sequence: Synthetic oligonucleotide
  Target: FXN; (-) strand; PAM type: YTN; PAM sequence: TTC
tgccatgtcttcttatacca

SEQ ID NO: 28488 - DNA, 20 bp, Artificial Sequence
  Description of Artificial Sequence: Synthetic oligonucleotide
  Target: FXN; (-) strand; PAM type: YTN; PAM sequence: CTT
ctgccatgtcttcttatacc

SEQ ID NO: 28489 - DNA, 20 bp, Artificial Sequence
  Description of Artificial Sequence: Synthetic oligonucleotide
  Target: FXN; (-) strand; PAM type: YTN; PAM sequence: CTG
gcttctgccatgtcttctta

SEQ ID NO: 28490 - DNA, 20 bp, Artificial Sequence
  Description of Artificial Sequence: Synthetic oligonucleotide
  Target: FXN; (-) strand; PAM type: YTN; PAM sequence: TTC
gtgtggacagatcggaggct

SEQ ID NO: 28491 - DNA, 20 bp, Artificial Sequence
  Description of Artificial Sequence: Synthetic oligonucleotide
  Target: FXN; (-) strand; PAM type: YTN; PAM sequence: CTG
tattcgtgtggacagatcgg

SEQ ID NO: 28492 - DNA, 20 bp, Artificial Sequence
  Description of Artificial Sequence: Synthetic oligonucleotide
  Target: FXN; (-) strand; PAM type: YTN; PAM sequence: TTG
ggaatgctgtattcgtgtgg

SEQ ID NO: 28493 - DNA, 20 bp, Artificial Sequence
  Description of Artificial Sequence: Synthetic oligonucleotide
  Target: FXN; (-) strand; PAM type: YTN; PAM sequence: TTT
gggaatgctgtattcgtgtg

SEQ ID NO: 28494 - DNA, 20 bp, Artificial Sequence
  Description of Artificial Sequence: Synthetic oligonucleotide
  Target: FXN; (-) strand; PAM type: YTN; PAM sequence: CTT
tgggaatgctgtattcgtgt

SEQ ID NO: 28495 - DNA, 20 bp, Artificial Sequence
  Description of Artificial Sequence: Synthetic oligonucleotide
  Target: FXN; (-) strand; PAM type: YTN; PAM sequence: TTG
ctttgggaatgctgtattcg

SEQ ID NO: 28496 - DNA, 20 bp, Artificial Sequence
  Description of Artificial Sequence: Synthetic oligonucleotide
  Target: FXN; (-) strand; PAM type: YTN; PAM sequence: CTC
atccagtgaataatggcaca

SEQ ID NO: 28497 - DNA, 20 bp, Artificial Sequence
  Description of Artificial Sequence: Synthetic oligonucleotide
  Target: FXN; (-) strand; PAM type: YTN; PAM sequence: CTC
aagctcatccagtgaataat

SEQ ID NO: 28498 - DNA, 20 bp, Artificial Sequence
  Description of Artificial Sequence: Synthetic oligonucleotide
  Target: FXN; (-) strand; PAM type: YTN; PAM sequence: TTC
atccacctcaagctcatcca

SEQ ID NO: 28499 - DNA, 20 bp, Artificial Sequence
  Description of Artificial Sequence: Synthetic oligonucleotide
  Target: FXN; (-) strand; PAM type: YTN; PAM sequence: CTA
gttcatccacctcaagctca

SEQ ID NO: 28500 - DNA, 20 bp, Artificial Sequence
  Description of Artificial Sequence: Synthetic oligonucleotide
  Target: FXN; (-) strand; PAM type: YTN; PAM sequence: CTG
gtgggctagttcatccacct

SEQ ID NO: 28501 - DNA, 20 bp, Artificial Sequence
  Description of Artificial Sequence: Synthetic oligonucleotide
  Target: FXN; (-) strand; PAM type: YTN; PAM sequence: TTG
agagcctggtgggctagttc

SEQ ID NO: 28502 - DNA, 20 bp, Artificial Sequence
  Description of Artificial Sequence: Synthetic oligonucleotide
  Target: FXN; (-) strand; PAM type: YTN; PAM sequence: TTC
atgacattgagagcctggtg

SEQ ID NO: 28503 - DNA, 20 bp, Artificial Sequence
  Description of Artificial Sequence: Synthetic oligonucleotide
  Target: FXN; (-) strand; PAM type: YTN; PAM sequence: TTA
aattcatgacattgagagcc

SEQ ID NO: 28504 - DNA, 20 bp, Artificial Sequence
  Description of Artificial Sequence: Synthetic oligonucleotide
  Target: FXN; (-) strand; PAM type: YTN; PAM sequence: TTC
agtgttaaattcatgacatt

SEQ ID NO: 28505 - DNA, 20 bp, Artificial Sequence
  Description of Artificial Sequence: Synthetic oligonucleotide
  Target: FXN; (-) strand; PAM type: YTN; PAM sequence: TTA
attcagtgttaaattcatga

SEQ ID NO: 28506 - DNA, 20 bp, Artificial Sequence
  Description of Artificial Sequence: Synthetic oligonucleotide
  Target: FXN; (-) strand; PAM type: YTN; PAM sequence: CTT
aattcagtgttaaattcatg

SEQ ID NO: 28507 - DNA, 20 bp, Artificial Sequence
  Description of Artificial Sequence: Synthetic oligonucleotide
  Target: FXN; (-) strand; PAM type: YTN; PAM sequence: TTC
ttaattcagtgttaaattca

SEQ ID NO: 28508 - DNA, 20 bp, Artificial Sequence
  Description of Artificial Sequence: Synthetic oligonucleotide
  Target: FXN; (-) strand; PAM type: YTN; PAM sequence: TTT
cttaattcagtgttaaattc

SEQ ID NO: 28509 - DNA, 20 bp, Artificial Sequence
  Description of Artificial Sequence: Synthetic oligonucleotide
  Target: FXN; (-) strand; PAM type: YTN; PAM sequence: TTT
tcttaattcagtgttaaatt

SEQ ID NO: 28510 - DNA, 20 bp, Artificial Sequence
  Description of Artificial Sequence: Synthetic oligonucleotide
  Target: FXN; (-) strand; PAM type: YTN; PAM sequence: TTT
ttcttaattcagtgttaaat

SEQ ID NO: 28511 - DNA, 20 bp, Artificial Sequence
  Description of Artificial Sequence: Synthetic oligonucleotide
  Target: FXN; (-) strand; PAM type: YTN; PAM sequence: TTA
aaacatatttttcttaattc

SEQ ID NO: 28512 - DNA, 20 bp, Artificial Sequence
  Description of Artificial Sequence: Synthetic oligonucleotide
  Target: FXN; (-) strand; PAM type: YTN; PAM sequence: TTT
aaaacatatttttcttaatt

SEQ ID NO: 28513 - DNA, 20 bp, Artificial Sequence
  Description of Artificial Sequence: Synthetic oligonucleotide
  Target: FXN; (-) strand; PAM type: YTN; PAM sequence: TTT
taaaacatatttttcttaat

SEQ ID NO: 28514 - DNA, 20 bp, Artificial Sequence
  Description of Artificial Sequence: Synthetic oligonucleotide
  Target: FXN; (-) strand; PAM type: YTN; PAM sequence: TTT
ttaaaacatatttttcttaa

SEQ ID NO: 28515 - DNA, 20 bp, Artificial Sequence
  Description of Artificial Sequence: Synthetic oligonucleotide
  Target: FXN; (-) strand; PAM type: YTN; PAM sequence: TTA
tttttaaaacatatttttct

SEQ ID NO: 28516 - DNA, 20 bp, Artificial Sequence
  Description of Artificial Sequence: Synthetic oligonucleotide
  Target: FXN; (-) strand; PAM type: YTN; PAM sequence: CTA
ttatttttaaaacatatttt

SEQ ID NO: 28517 - DNA, 20 bp, Artificial Sequence
  Description of Artificial Sequence: Synthetic oligonucleotide
  Target: FXN; (-) strand; PAM type: YTN; PAM sequence: CTA
aactattatttttaaaacat

SEQ ID NO: 28518 - DNA, 20 bp, Artificial Sequence
  Description of Artificial Sequence: Synthetic oligonucleotide
  Target: FXN; (-) strand; PAM type: YTN; PAM sequence: CTA
gcaccccagcaatcacctaa

SEQ ID NO: 28519 - DNA, 20 bp, Artificial Sequence
  Description of Artificial Sequence: Synthetic oligonucleotide
  Target: FXN; (-) strand; PAM type: YTN; PAM sequence: CTC
ctagcaccccagcaatcacc

SEQ ID NO: 28520 - DNA, 20 bp, Artificial Sequence
  Description of Artificial Sequence: Synthetic oligonucleotide
  Target: FXN; (-) strand; PAM type: YTN; PAM sequence: CTC
tcctagcaccccagcaatca

SEQ ID NO: 28521 - DNA, 20 bp, Artificial Sequence
  Description of Artificial Sequence: Synthetic oligonucleotide
  Target: FXN; (-) strand; PAM type: YTN; PAM sequence: TTC
ctctcctagcaccccagcaa

SEQ ID NO: 28522 - DNA, 20 bp, Artificial Sequence
  Description of Artificial Sequence: Synthetic oligonucleotide
  Target: FXN; (-) strand; PAM type: YTN; PAM sequence: CTT
cctctcctagcaccccagca

SEQ ID NO: 28523 - DNA, 20 bp, Artificial Sequence
  Description of Artificial Sequence: Synthetic oligonucleotide
  Target: FXN; (-) strand; PAM type: YTN; PAM sequence: TTC
cttcctctcctagcacccca

SEQ ID NO: 28524 - DNA, 20 bp, Artificial Sequence
  Description of Artificial Sequence: Synthetic oligonucleotide
  Target: FXN; (-) strand; PAM type: YTN; PAM sequence: TTC
cccattccttcctctcctag

SEQ ID NO: 28525 - DNA, 20 bp, Artificial Sequence
  Description of Artificial Sequence: Synthetic oligonucleotide
  Target: FXN; (-) strand; PAM type: YTN; PAM sequence: TTA
ttccccattccttcctctcc

SEQ ID NO: 28526 - DNA, 20 bp, Artificial Sequence
  Description of Artificial Sequence: Synthetic oligonucleotide
  Target: FXN; (-) strand; PAM type: YTN; PAM sequence: TTA
aacagttattccccattcct

SEQ ID NO: 28527 - DNA, 20 bp, Artificial Sequence
  Description of Artificial Sequence: Synthetic oligonucleotide
  Target: FXN; (-) strand; PAM type: YTN; PAM sequence: CTA
tacccattaaacagttattc

SEQ ID NO: 28528 - DNA, 20 bp, Artificial Sequence
  Description of Artificial Sequence: Synthetic oligonucleotide
  Target: FXN; (-) strand; PAM type: YTN; PAM sequence: TTG
aatcagatgtggaacccaca

SEQ ID NO: 28529 - DNA, 20 bp, Artificial Sequence
  Description of Artificial Sequence: Synthetic oligonucleotide
  Target: FXN; (-) strand; PAM type: YTN; PAM sequence: TTG
gttgaatcagatgtggaacc

SEQ ID NO: 28530 - DNA, 20 bp, Artificial Sequence
  Description of Artificial Sequence: Synthetic oligonucleotide
  Target: FXN; (-) strand; PAM type: YTN; PAM sequence: TTG
atccacggttggttgaatca

SEQ ID NO: 28531 - DNA, 20 bp, Artificial Sequence
  Description of Artificial Sequence: Synthetic oligonucleotide
  Target: FXN; (-) strand; PAM type: YTN; PAM sequence: TTT
gatccacggttggttgaatc

SEQ ID NO: 28532 - DNA, 20 bp, Artificial Sequence
  Description of Artificial Sequence: Synthetic oligonucleotide
  Target: FXN; (-) strand; PAM type: YTN; PAM sequence: TTT
tgatccacggttggttgaat

SEQ ID NO: 28533 - DNA, 20 bp, Artificial Sequence
  Description of Artificial Sequence: Synthetic oligonucleotide
  Target: FXN; (-) strand; PAM type: YTN; PAM sequence: TTC
aaatattttgatccacggtt

SEQ ID NO: 28534 - DNA, 20 bp, Artificial Sequence
  Description of Artificial Sequence: Synthetic oligonucleotide
  Target: FXN; (-) strand; PAM type: YTN; PAM sequence: TTT
caaatattttgatccacggt

SEQ ID NO: 28535 - DNA, 20 bp, Artificial Sequence
  Description of Artificial Sequence: Synthetic oligonucleotide
  Target: FXN; (-) strand; PAM type: YTN; PAM sequence: TTT
tcaaatattttgatccacgg

SEQ ID NO: 28536 - DNA, 20 bp, Artificial Sequence
  Description of Artificial Sequence: Synthetic oligonucleotide
  Target: FXN; (-) strand; PAM type: YTN; PAM sequence: TTA
ttttcaaatattttgatcca

SEQ ID NO: 28537 - DNA, 20 bp, Artificial Sequence
  Description of Artificial Sequence: Synthetic oligonucleotide
  Target: FXN; (-) strand; PAM type: YTN; PAM sequence: TTT
attttcaaatattttgatcc

SEQ ID NO: 28538 - DNA, 20 bp, Artificial Sequence
  Description of Artificial Sequence: Synthetic oligonucleotide
  Target: FXN; (-) strand; PAM type: YTN; PAM sequence: TTT
tattttcaaatattttgatc

SEQ ID NO: 28539 - DNA, 20 bp, Artificial Sequence
  Description of Artificial Sequence: Synthetic oligonucleotide
  Target: FXN; (-) strand; PAM type: YTN; PAM sequence: TTT
ttattttcaaatattttgat

SEQ ID NO: 28540 - DNA, 20 bp, Artificial Sequence
  Description of Artificial Sequence: Synthetic oligonucleotide
  Target: FXN; (-) strand; PAM type: YTN; PAM sequence: TTT
tttattttcaaatattttga

SEQ ID NO: 28541 - DNA, 20 bp, Artificial Sequence
  Description of Artificial Sequence: Synthetic oligonucleotide
  Target: FXN; (-) strand; PAM type: YTN; PAM sequence: TTG
ttttttattttcaaatattt

SEQ ID NO: 28542 - DNA, 20 bp, Artificial Sequence
  Description of Artificial Sequence: Synthetic oligonucleotide
  Target: FXN; (-) strand; PAM type: YTN; PAM sequence: TTT
gttttttattttcaaatatt

SEQ ID NO: 28543 - DNA, 20 bp, Artificial Sequence
  Description of Artificial Sequence: Synthetic oligonucleotide
  Target: FXN; (-) strand; PAM type: YTN; PAM sequence: TTT
tgttttttattttcaaatat

SEQ ID NO: 28544 - DNA, 20 bp, Artificial Sequence
  Description of Artificial Sequence: Synthetic oligonucleotide
  Target: FXN; (-) strand; PAM type: YTN; PAM sequence: TTG
ttttgttttttattttcaaa

SEQ ID NO: 28545 - DNA, 20 bp, Artificial Sequence
  Description of Artificial Sequence: Synthetic oligonucleotide
  Target: FXN; (-) strand; PAM type: YTN; PAM sequence: TTT
gttttgttttttattttcaa

SEQ ID NO: 28546 - DNA, 20 bp, Artificial Sequence
  Description of Artificial Sequence: Synthetic oligonucleotide
  Target: FXN; (-) strand; PAM type: YTN; PAM sequence: TTT
tgttttgttttttattttca

SEQ ID NO: 28547 - DNA, 20 bp, Artificial Sequence
  Description of Artificial Sequence: Synthetic oligonucleotide
  Target: FXN; (-) strand; PAM type: YTN; PAM sequence: TTT
ttgttttgttttttattttc

SEQ ID NO: 28548 - DNA, 20 bp, Artificial Sequence
  Description of Artificial Sequence: Synthetic oligonucleotide
  Target: FXN; (-) strand; PAM type: YTN; PAM sequence: TTG
tatcatttttgttttgtttt

SEQ ID NO: 28549 - DNA, 20 bp, Artificial Sequence
  Description of Artificial Sequence: Synthetic oligonucleotide
  Target: FXN; (-) strand; PAM type: YTN; PAM sequence: TTT
gtatcatttttgttttgttt

SEQ ID NO: 28550 - DNA, 20 bp, Artificial Sequence
  Description of Artificial Sequence: Synthetic oligonucleotide
  Target: FXN; (-) strand; PAM type: YTN; PAM sequence: TTA
tttgtatcatttttgttttg

SEQ ID NO: 28551 - DNA, 20 bp, Artificial Sequence
  Description of Artificial Sequence: Synthetic oligonucleotide
  Target: FXN; (-) strand; PAM type: YTN; PAM sequence: TTT
atttgtatcatttttgtttt

SEQ ID NO: 28552 - DNA, 20 bp, Artificial Sequence
  Description of Artificial Sequence: Synthetic oligonucleotide
  Target: FXN; (-) strand; PAM type: YTN; PAM sequence: TTT
tatttgtatcatttttgttt

SEQ ID NO: 28553 - DNA, 20 bp, Artificial Sequence
  Description of Artificial Sequence: Synthetic oligonucleotide
  Target: FXN; (-) strand; PAM type: YTN; PAM sequence: TTT
ttatttgtatcatttttgtt

SEQ ID NO: 28554 - DNA, 20 bp, Artificial Sequence
  Description of Artificial Sequence: Synthetic oligonucleotide
  Target: FXN; (-) strand; PAM type: YTN; PAM sequence: TTG
gtttttatttgtatcatttt

SEQ ID NO: 28555 - DNA, 20 bp, Artificial Sequence
  Description of Artificial Sequence: Synthetic oligonucleotide
  Target: FXN; (-) strand; PAM type: YTN; PAM sequence: TTA
tattggtttttatttgtatc

SEQ ID NO: 28556 - DNA, 20 bp, Artificial Sequence
  Description of Artificial Sequence: Synthetic oligonucleotide
  Target: FXN; (-) strand; PAM type: YTN; PAM sequence: TTG
ttatattggtttttatttgt

SEQ ID NO: 28557 - DNA, 20 bp, Artificial Sequence
  Description of Artificial Sequence: Synthetic oligonucleotide
  Target: FXN; (-) strand; PAM type: YTN; PAM sequence: TTA
atagttgttatattggtttt

SEQ ID NO: 28558 - DNA, 20 bp, Artificial Sequence
  Description of Artificial Sequence: Synthetic oligonucleotide
  Target: FXN; (-) strand; PAM type: YTN; PAM sequence: CTG
ttaatagttgttatattggt

SEQ ID NO: 28559 - DNA, 20 bp, Artificial Sequence
  Description of Artificial Sequence: Synthetic oligonucleotide
  Target: FXN; (-) strand; PAM type: YTN; PAM sequence: CTA
gtacaatgtaaatgctgtta

SEQ ID NO: 28560 - DNA, 20 bp, Artificial Sequence
  Description of Artificial Sequence: Synthetic oligonucleotide
  Target: FXN; (-) strand; PAM type: YTN; PAM sequence: TTA
taatgcctagtacaatgtaa

SEQ ID NO: 28561 - DNA, 20 bp, Artificial Sequence
  Description of Artificial Sequence: Synthetic oligonucleotide
  Target: FXN; (-) strand; PAM type: YTN; PAM sequence: CTT
ataatgcctagtacaatgta

SEQ ID NO: 28562 - DNA, 20 bp, Artificial Sequence
  Description of Artificial Sequence: Synthetic oligonucleotide
  Target: FXN; (-) strand; PAM type: YTN; PAM sequence: TTA
cttataatgcctagtacaat

SEQ ID NO: 28563 - DNA, 20 bp, Artificial Sequence
  Description of Artificial Sequence: Synthetic oligonucleotide
  Target: FXN; (-) strand; PAM type: YTN; PAM sequence: CTC
cagattacttataatgccta

SEQ ID NO: 28564 - DNA, 20 bp, Artificial Sequence
  Description of Artificial Sequence: Synthetic oligonucleotide
  Target: FXN; (-) strand; PAM type: YTN; PAM sequence: TTA
agtcatctccagattactta

SEQ ID NO: 28565 - DNA, 20 bp, Artificial Sequence
  Description of Artificial Sequence: Synthetic oligonucleotide
  Target: FXN; (-) strand; PAM type: YTN; PAM sequence: TTT
aagtcatctccagattactt

SEQ ID NO: 28566 - DNA, 20 bp, Artificial Sequence
  Description of Artificial Sequence: Synthetic oligonucleotide
  Target: FXN; (-) strand; PAM type: YTN; PAM sequence: CTT
taagtcatctccagattact

SEQ ID NO: 28567 - DNA, 20 bp, Artificial Sequence
  Description of Artificial Sequence: Synthetic oligonucleotide
  Target: FXN; (-) strand; PAM type: YTN; PAM sequence: CTG
tatgctttaagtcatctcca

SEQ ID NO: 28568 - DNA, 20 bp, Artificial Sequence
  Description of Artificial Sequence: Synthetic oligonucleotide
  Target: FXN; (-) strand; PAM type: YTN; PAM sequence: TTC
tgtatgctttaagtcatctc

SEQ ID NO: 28569 - DNA, 20 bp, Artificial Sequence
  Description of Artificial Sequence: Synthetic oligonucleotide
  Target: FXN; (-) strand; PAM type: YTN; PAM sequence: CTT
ctgtatgctttaagtcatct

SEQ ID NO: 28570 - DNA, 20 bp, Artificial Sequence
  Description of Artificial Sequence: Synthetic oligonucleotide
  Target: FXN; (-) strand; PAM type: YTN; PAM sequence: CTA
ggcacatccttctgtatgct

SEQ ID NO: 28571 - DNA, 20 bp, Artificial Sequence
  Description of Artificial Sequence: Synthetic oligonucleotide
  Target: FXN; (-) strand; PAM type: YTN; PAM sequence: CTA
acctaggcacatccttctgt

SEQ ID NO: 28572 - DNA, 20 bp, Artificial Sequence
  Description of Artificial Sequence: Synthetic oligonucleotide
  Target: FXN; (-) strand; PAM type: YTN; PAM sequence: CTG
atatgaaatggtacgataca

SEQ ID NO: 28573 - DNA, 20 bp, Artificial Sequence
  Description of Artificial Sequence: Synthetic oligonucleotide
  Target: FXN; (-) strand; PAM type: YTN; PAM sequence: CTC
aagtccctgatatgaaatgg

SEQ ID NO: 28574 - DNA, 20 bp, Artificial Sequence
  Description of Artificial Sequence: Synthetic oligonucleotide
  Target: FXN; (-) strand; PAM type: YTN; PAM sequence: CTG
cagataccaaaatccgtggg

SEQ ID NO: 28575 - DNA, 20 bp, Artificial Sequence
  Description of Artificial Sequence: Synthetic oligonucleotide
  Target: FXN; (-) strand; PAM type: YTN; PAM sequence: TTC
caggatctgcagataccaaa

SEQ ID NO: 28576 - DNA, 20 bp, Artificial Sequence
  Description of Artificial Sequence: Synthetic oligonucleotide
  Target: FXN; (-) strand; PAM type: YTN; PAM sequence: TTG
gtatccatagggaaggggtt

SEQ ID NO: 28577 - DNA, 20 bp, Artificial Sequence
  Description of Artificial Sequence: Synthetic oligonucleotide
  Target: FXN; (-) strand; PAM type: YTN; PAM sequence: CTT
ggtatccatagggaaggggt

SEQ ID NO: 28578 - DNA, 20 bp, Artificial Sequence
  Description of Artificial Sequence: Synthetic oligonucleotide
  Target: FXN; (-) strand; PAM type: YTN; PAM sequence: TTC
cttggtatccatagggaagg

SEQ ID NO: 28579 - DNA, 20 bp, Artificial Sequence
  Description of Artificial Sequence: Synthetic oligonucleotide
  Target: FXN; (-) strand; PAM type: YTN; PAM sequence: TTG
ttccttggtatccataggga

SEQ ID NO: 28580 - DNA, 20 bp, Artificial Sequence
  Description of Artificial Sequence: Synthetic oligonucleotide
  Target: FXN; (-) strand; PAM type: YTN; PAM sequence: CTG
ttgttccttggtatccatag

SEQ ID NO: 28581 - DNA, 20 bp, Artificial Sequence
  Description of Artificial Sequence: Synthetic oligonucleotide
  Target: FXN; (-) strand; PAM type: YTN; PAM sequence: CTG
catcaccccaaaaggagacc

SEQ ID NO: 28582 - DNA, 20 bp, Artificial Sequence
  Description of Artificial Sequence: Synthetic oligonucleotide
  Target: FXN; (-) strand; PAM type: YTN; PAM sequence: TTC
aaaacatctgcatcacccca

SEQ ID NO: 28583 - DNA, 20 bp, Artificial Sequence
  Description of Artificial Sequence: Synthetic oligonucleotide
  Target: FXN; (-) strand; PAM type: YTN; PAM sequence: CTT
caaaacatctgcatcacccc

SEQ ID NO: 28584 - DNA, 20 bp, Artificial Sequence
  Description of Artificial Sequence: Synthetic oligonucleotide
  Target: FXN; (-) strand; PAM type: YTN; PAM sequence: CTA
gcttcaaaacatctgcatca

SEQ ID NO: 28585 - DNA, 20 bp, Artificial Sequence
  Description of Artificial Sequence: Synthetic oligonucleotide
  Target: FXN; (-) strand; PAM type: YTN; PAM sequence: CTG
cctagcttcaaaacatctgc

SEQ ID NO: 28586 - DNA, 20 bp, Artificial Sequence
  Description of Artificial Sequence: Synthetic oligonucleotide
  Target: FXN; (-) strand; PAM type: YTN; PAM sequence: CTC
tgcctagcttcaaaacatct

SEQ ID NO: 28587 - DNA, 20 bp, Artificial Sequence
  Description of Artificial Sequence: Synthetic oligonucleotide
  Target: FXN; (-) strand; PAM type: YTN; PAM sequence: CTA
cctctgcctagcttcaaaac

SEQ ID NO: 28588 - DNA, 20 bp, Artificial Sequence
  Description of Artificial Sequence: Synthetic oligonucleotide
  Target: FXN; (-) strand; PAM type: YTN; PAM sequence: TTG
tgcaaccactacctctgcct

SEQ ID NO: 28589 - DNA, 20 bp, Artificial Sequence
  Description of Artificial Sequence: Synthetic oligonucleotide
  Target: FXN; (-) strand; PAM type: YTN; PAM sequence: TTA
caatgttgtgcaaccactac

SEQ ID NO: 28590 - DNA, 20 bp, Artificial Sequence
  Description of Artificial Sequence: Synthetic oligonucleotide
  Target: FXN; (-) strand; PAM type: YTN; PAM sequence: TTT
acaatgttgtgcaaccacta

SEQ ID NO: 28591 - DNA, 20 bp, Artificial Sequence
  Description of Artificial Sequence: Synthetic oligonucleotide
  Target: FXN; (-) strand; PAM type: YTN; PAM sequence: TTA
gtacatttacaatgttgtgc

SEQ ID NO: 28592 - DNA, 20 bp, Artificial Sequence
  Description of Artificial Sequence: Synthetic oligonucleotide
  Target: FXN; (-) strand; PAM type: YTN; PAM sequence: TTT
agtacatttacaatgttgtg

SEQ ID NO: 28593 - DNA, 20 bp, Artificial Sequence
  Description of Artificial Sequence: Synthetic oligonucleotide
  Target: FXN; (-) strand; PAM type: YTN; PAM sequence: TTG
gtggcatttagtacatttac

SEQ ID NO: 28594 - DNA, 20 bp, Artificial Sequence
  Description of Artificial Sequence: Synthetic oligonucleotide
  Target: FXN; (-) strand; PAM type: YTN; PAM sequence: TTT
ggtggcatttagtacattta

SEQ ID NO: 28595 - DNA, 20 bp, Artificial Sequence
  Description of Artificial Sequence: Synthetic oligonucleotide
  Target: FXN; (-) strand; PAM type: YTN; PAM sequence: TTA
aaaatgaataatttggtggc

SEQ ID NO: 28596 - DNA, 20 bp, Artificial Sequence
  Description of Artificial Sequence: Synthetic oligonucleotide
  Target: FXN; (-) strand; PAM type: YTN; PAM sequence: TTT
aaaaatgaataatttggtgg

SEQ ID NO: 28597 - DNA, 20 bp, Artificial Sequence
  Description of Artificial Sequence: Synthetic oligonucleotide
  Target: FXN; (-) strand; PAM type: YTN; PAM sequence: TTA
accatttaaaaatgaataat

SEQ ID NO: 28598 - DNA, 20 bp, Artificial Sequence
  Description of Artificial Sequence: Synthetic oligonucleotide
  Target: FXN; (-) strand; PAM type: YTN; PAM sequence: TTC
acataacacattaaccattt

SEQ ID NO: 28599 - DNA, 20 bp, Artificial Sequence
  Description of Artificial Sequence: Synthetic oligonucleotide
  Target: FXN; (-) strand; PAM type: YTN; PAM sequence: TTA
aggtgaaattcacataacac

SEQ ID NO: 28600 - DNA, 20 bp, Artificial Sequence
  Description of Artificial Sequence: Synthetic oligonucleotide
  Target: FXN; (-) strand; PAM type: YTN; PAM sequence: TTG
ttaaggtgaaattcacataa

SEQ ID NO: 28601 - DNA, 20 bp, Artificial Sequence
  Description of Artificial Sequence: Synthetic oligonucleotide
  Target: FXN; (-) strand; PAM type: YTN; PAM sequence: TTA
gttgttaaggtgaaattcac

SEQ ID NO: 28602 - DNA, 20 bp, Artificial Sequence
  Description of Artificial Sequence: Synthetic oligonucleotide
  Target: FXN; (-) strand; PAM type: YTN; PAM sequence: TTA
ttagttgttaaggtgaaatt

SEQ ID NO: 28603 - DNA, 20 bp, Artificial Sequence
  Description of Artificial Sequence: Synthetic oligonucleotide
  Target: FXN; (-) strand; PAM type: YTN; PAM sequence: CTA
taatattattagttgttaag

SEQ ID NO: 28604 - DNA, 20 bp, Artificial Sequence
  Description of Artificial Sequence: Synthetic oligonucleotide
  Target: FXN; (-) strand; PAM type: YTN; PAM sequence: TTA
cctataatattattagttgt

SEQ ID NO: 28605 - DNA, 20 bp, Artificial Sequence
  Description of Artificial Sequence: Synthetic oligonucleotide
  Target: FXN; (-) strand; PAM type: YTN; PAM sequence: CTT
acctataatattattagttg

SEQ ID NO: 28606 - DNA, 20 bp, Artificial Sequence
  Description of Artificial Sequence: Synthetic oligonucleotide
  Target: FXN; (-) strand; PAM type: YTN; PAM sequence: TTG
tgccttacctataatattat

SEQ ID NO: 28607 - DNA, 20 bp, Artificial Sequence
  Description of Artificial Sequence: Synthetic oligonucleotide
  Target: FXN; (-) strand; PAM type: YTN; PAM sequence: CTT
gtgccttacctataatatta

SEQ ID NO: 28608 - DNA, 20 bp, Artificial Sequence
  Description of Artificial Sequence: Synthetic oligonucleotide
  Target: FXN; (-) strand; PAM type: YTN; PAM sequence: CTA
cagatgtaacttgtgcctta

SEQ ID NO: 28609 - DNA, 20 bp, Artificial Sequence
  Description of Artificial Sequence: Synthetic oligonucleotide
  Target: FXN; (-) strand; PAM type: YTN; PAM sequence: TTG
tgctacagatgtaacttgtg

SEQ ID NO: 28610 - DNA, 20 bp, Artificial Sequence
  Description of Artificial Sequence: Synthetic oligonucleotide
  Target: FXN; (-) strand; PAM type: YTN; PAM sequence: TTT
gtgctacagatgtaacttgt

SEQ ID NO: 28611 - DNA, 20 bp, Artificial Sequence
  Description of Artificial Sequence: Synthetic oligonucleotide
  Target: FXN; (-) strand; PAM type: YTN; PAM sequence: TTT
tgtgctacagatgtaacttg

SEQ ID NO: 28612 - DNA, 20 bp, Artificial Sequence
  Description of Artificial Sequence: Synthetic oligonucleotide
  Target: FXN; (-) strand; PAM type: YTN; PAM sequence: TTT
ttgtgctacagatgtaactt

SEQ ID NO: 28613 - DNA, 20 bp, Artificial Sequence
  Description of Artificial Sequence: Synthetic oligonucleotide
  Target: FXN; (-) strand; PAM type: YTN; PAM sequence: TTA
gggccatttttgtgctacag

SEQ ID NO: 28614 - DNA, 20 bp, Artificial Sequence
  Description of Artificial Sequence: Synthetic oligonucleotide
  Target: FXN; (-) strand; PAM type: YTN; PAM sequence: TTA
aaaattagggccatttttgt

SEQ ID NO: 28615 - DNA, 20 bp, Artificial Sequence
  Description of Artificial Sequence: Synthetic oligonucleotide
  Target: FXN; (-) strand; PAM type: YTN; PAM sequence: TTT
aaaaattagggccatttttg

SEQ ID NO: 28616 - DNA, 20 bp, Artificial Sequence
  Description of Artificial Sequence: Synthetic oligonucleotide
  Target: FXN; (-) strand; PAM type: YTN; PAM sequence: TTT
taaaaattagggccattttt

SEQ ID NO: 28617 - DNA, 20 bp, Artificial Sequence
  Description of Artificial Sequence: Synthetic oligonucleotide
  Target: FXN; (-) strand; PAM type: YTN; PAM sequence: CTG
gagcagtgttttaaaaatta

SEQ ID NO: 28618 - DNA, 20 bp, Artificial Sequence
  Description of Artificial Sequence: Synthetic oligonucleotide
  Target: FXN; (-) strand; PAM type: YTN; PAM sequence: CTA
tgctggagcagtgttttaaa

SEQ ID NO: 28619 - DNA, 20 bp, Artificial Sequence
  Description of Artificial Sequence: Synthetic oligonucleotide
  Target: FXN; (-) strand; PAM type: YTN; PAM sequence: CTG
ctatgctggagcagtgtttt

SEQ ID NO: 28620 - DNA, 20 bp, Artificial Sequence
  Description of Artificial Sequence: Synthetic oligonucleotide
  Target: FXN; (-) strand; PAM type: YTN; PAM sequence: CTC
acatgtgatacctgctatgc

SEQ ID NO: 28621 - DNA, 20 bp, Artificial Sequence
  Description of Artificial Sequence: Synthetic oligonucleotide
  Target: FXN; (-) strand; PAM type: YTN; PAM sequence: CTA
cctcacatgtgatacctgct

SEQ ID NO: 28622 - DNA, 20 bp, Artificial Sequence
  Description of Artificial Sequence: Synthetic oligonucleotide
  Target: FXN; (-) strand; PAM type: YTN; PAM sequence: TTG
ctacctcacatgtgatacct

SEQ ID NO: 28623 - DNA, 20 bp, Artificial Sequence
  Description of Artificial Sequence: Synthetic oligonucleotide
  Target: FXN; (-) strand; PAM type: YTN; PAM sequence: TTT
gctacctcacatgtgatacc

SEQ ID NO: 28624 - DNA, 20 bp, Artificial Sequence
  Description of Artificial Sequence: Synthetic oligonucleotide
  Target: FXN; (-) strand; PAM type: YTN; PAM sequence: TTT
tgctacctcacatgtgatac

SEQ ID NO: 28625 - DNA, 20 bp, Artificial Sequence
  Description of Artificial Sequence: Synthetic oligonucleotide
  Target: FXN; (-) strand; PAM type: YTN; PAM sequence: CTT
ttgctacctcacatgtgata

SEQ ID NO: 28626 - DNA, 20 bp, Artificial Sequence
  Description of Artificial Sequence: Synthetic oligonucleotide
  Target: FXN; (-) strand; PAM type: YTN; PAM sequence: CTC
cagcttttgctacctcacat

SEQ ID NO: 28627 - DNA, 20 bp, Artificial Sequence
  Description of Artificial Sequence: Synthetic oligonucleotide
  Target: FXN; (-) strand; PAM type: YTN; PAM sequence: TTG
atctccagcttttgctacct

SEQ ID NO: 28628 - DNA, 20 bp, Artificial Sequence
  Description of Artificial Sequence: Synthetic oligonucleotide
  Target: FXN; (-) strand; PAM type: YTN; PAM sequence: TTT
gatctccagcttttgctacc

SEQ ID NO: 28629 - DNA, 20 bp, Artificial Sequence
  Description of Artificial Sequence: Synthetic oligonucleotide
  Target: FXN; (-) strand; PAM type: YTN; PAM sequence: CTT
tgatctccagcttttgctac

SEQ ID NO: 28630 - DNA, 20 bp, Artificial Sequence
  Description of Artificial Sequence: Synthetic oligonucleotide
  Target: FXN; (-) strand; PAM type: YTN; PAM sequence: CTC
caggtatcacactttgatct

SEQ ID NO: 28631 - DNA, 20 bp, Artificial Sequence
  Description of Artificial Sequence: Synthetic oligonucleotide
  Target: FXN; (-) strand; PAM type: YTN; PAM sequence: CTG
ataagtctccaggtatcaca

SEQ ID NO: 28632 - DNA, 20 bp, Artificial Sequence
  Description of Artificial Sequence: Synthetic oligonucleotide
  Target: FXN; (-) strand; PAM type: YTN; PAM sequence: TTA
ctgataagtctccaggtatc

SEQ ID NO: 28633 - DNA, 20 bp, Artificial Sequence
  Description of Artificial Sequence: Synthetic oligonucleotide
  Target: FXN; (-) strand; PAM type: YTN; PAM sequence: CTT
actgataagtctccaggtat

SEQ ID NO: 28634 - DNA, 20 bp, Artificial Sequence
  Description of Artificial Sequence: Synthetic oligonucleotide
  Target: FXN; (-) strand; PAM type: YTN; PAM sequence: TTG
acccttactgataagtctcc

SEQ ID NO: 28635 - DNA, 20 bp, Artificial Sequence
  Description of Artificial Sequence: Synthetic oligonucleotide
  Target: FXN; (-) strand; PAM type: YTN; PAM sequence: TTT
gacccttactgataagtctc

SEQ ID NO: 28636 - DNA, 20 bp, Artificial Sequence
  Description of Artificial Sequence: Synthetic oligonucleotide
  Target: FXN; (-) strand; PAM type: YTN; PAM sequence: CTG
aaaaaacatttgacccttac

SEQ ID NO: 28637 - DNA, 20 bp, Artificial Sequence
  Description of Artificial Sequence: Synthetic oligonucleotide
  Target: FXN; (-) strand; PAM type: YTN; PAM sequence: CTC
aaaacctgaaaaaacatttg

SEQ ID NO: 28638 - DNA, 20 bp, Artificial Sequence
  Description of Artificial Sequence: Synthetic oligonucleotide
  Target: FXN; (-) strand; PAM type: YTN; PAM sequence: TTC
tcaaaacctgaaaaaacatt

SEQ ID NO: 28639 - DNA, 20 bp, Artificial Sequence
  Description of Artificial Sequence: Synthetic oligonucleotide
  Target: FXN; (-) strand; PAM type: YTN; PAM sequence: TTC
caagaatgattctcaaaacc

SEQ ID NO: 28640 - DNA, 20 bp, Artificial Sequence
  Description of Artificial Sequence: Synthetic oligonucleotide
  Target: FXN; (-) strand; PAM type: YTN; PAM sequence: CTG
gaacaattccaagaatgatt

SEQ ID NO: 28641 - DNA, 20 bp, Artificial Sequence
  Description of Artificial Sequence: Synthetic oligonucleotide
  Target: FXN; (-) strand; PAM type: YTN; PAM sequence: TTC
tggaacaattccaagaatga

SEQ ID NO: 28642 - DNA, 20 bp, Artificial Sequence
  Description of Artificial Sequence: Synthetic oligonucleotide
  Target: FXN; (-) strand; PAM type: YTN; PAM sequence: CTT
ctggaacaattccaagaatg

SEQ ID NO: 28643 - DNA, 20 bp, Artificial Sequence
  Description of Artificial Sequence: Synthetic oligonucleotide
  Target: FXN; (-) strand; PAM type: YTN; PAM sequence: TTA
tacgatatatcttctggaac

SEQ ID NO: 28644 - DNA, 20 bp, Artificial Sequence
  Description of Artificial Sequence: Synthetic oligonucleotide
  Target: FXN; (-) strand; PAM type: YTN; PAM sequence: CTA
agaagagttatacgatatat

SEQ ID NO: 28645 - DNA, 20 bp, Artificial Sequence
  Description of Artificial Sequence: Synthetic oligonucleotide
  Target: FXN; (-) strand; PAM type: YTN; PAM sequence: TTA
gcatctaagaagagttatac

SEQ ID NO: 28646 - DNA, 20 bp, Artificial Sequence
  Description of Artificial Sequence: Synthetic oligonucleotide
  Target: FXN; (-) strand; PAM type: YTN; PAM sequence: CTT
agcatctaagaagagttata

SEQ ID NO: 28647 - DNA, 20 bp, Artificial Sequence
  Description of Artificial Sequence: Synthetic oligonucleotide
  Target: FXN; (-) strand; PAM type: YTN; PAM sequence: TTA
tcttagcatctaagaagagt

SEQ ID NO: 28648 - DNA, 20 bp, Artificial Sequence
  Description of Artificial Sequence: Synthetic oligonucleotide
  Target: FXN; (-) strand; PAM type: YTN; PAM sequence: CTT
atcttagcatctaagaagag

SEQ ID NO: 28649 - DNA, 20 bp, Artificial Sequence
  Description of Artificial Sequence: Synthetic oligonucleotide
  Target: FXN; (-) strand; PAM type: YTN; PAM sequence: TTC
ttatcttagcatctaagaag

SEQ ID NO: 28650 - DNA, 20 bp, Artificial Sequence
  Description of Artificial Sequence: Synthetic oligonucleotide
  Target: FXN; (-) strand; PAM type: YTN; PAM sequence: CTT
cttatcttagcatctaagaa

SEQ ID NO: 28651 - DNA, 20 bp, Artificial Sequence
  Description of Artificial Sequence: Synthetic oligonucleotide
  Target: FXN; (-) strand; PAM type: YTN; PAM sequence: CTG
ccttcttatcttagcatcta

SEQ ID NO: 28652 - DNA, 20 bp, Artificial Sequence
  Description of Artificial Sequence: Synthetic oligonucleotide
  Target: FXN; (-) strand; PAM type: YTN; PAM sequence: CTA
gtgtatatctgccttcttat

SEQ ID NO: 28653 - DNA, 20 bp, Artificial Sequence
  Description of Artificial Sequence: Synthetic oligonucleotide
  Target: FXN; (-) strand; PAM type: YTN; PAM sequence: CTA
gaaaataacacaaaatgagc

SEQ ID NO: 28654 - DNA, 20 bp, Artificial Sequence
  Description of Artificial Sequence: Synthetic oligonucleotide
  Target: FXN; (-) strand; PAM type: YTN; PAM sequence: CTC
tagaaaataacacaaaatga

SEQ ID NO: 28655 - DNA, 20 bp, Artificial Sequence
  Description of Artificial Sequence: Synthetic oligonucleotide
  Target: FXN; (-) strand; PAM type: YTN; PAM sequence: CTG
gagtaaagctctagaaaata

SEQ ID NO: 28656 - DNA, 20 bp, Artificial Sequence
  Description of Artificial Sequence: Synthetic oligonucleotide
  Target: FXN; (-) strand; PAM type: YTN; PAM sequence: TTG
actggagtaaagctctagaa

SEQ ID NO: 28657 - DNA, 20 bp, Artificial Sequence
  Description of Artificial Sequence: Synthetic oligonucleotide
  Target: FXN; (-) strand; PAM type: YTN; PAM sequence: CTG
cccccaagaaattgactgga

SEQ ID NO: 28658 - DNA, 20 bp, Artificial Sequence
  Description of Artificial Sequence: Synthetic oligonucleotide
  Target: FXN; (-) strand; PAM type: YTN; PAM sequence: TTC
cacaaatgctgcccccaaga

SEQ ID NO: 28659 - DNA, 20 bp, Artificial Sequence
  Description of Artificial Sequence: Synthetic oligonucleotide
  Target: FXN; (-) strand; PAM type: YTN; PAM sequence: CTG
attccacaaatgctgccccc

SEQ ID NO: 28660 - DNA, 20 bp, Artificial Sequence
  Description of Artificial Sequence: Synthetic oligonucleotide
  Target: FXN; (-) strand; PAM type: YTN; PAM sequence: TTC
agatgaaccactgattccac

SEQ ID NO: 28661 - DNA, 20 bp, Artificial Sequence
  Description of Artificial Sequence: Synthetic oligonucleotide
  Target: FXN; (-) strand; PAM type: YTN; PAM sequence: CTT
cagatgaaccactgattcca

SEQ ID NO: 28662 - DNA, 20 bp, Artificial Sequence
  Description of Artificial Sequence: Synthetic oligonucleotide
  Target: FXN; (-) strand; PAM type: YTN; PAM sequence: TTC
cacagcacagcccttcagat

SEQ ID NO: 28663 - DNA, 20 bp, Artificial Sequence
  Description of Artificial Sequence: Synthetic oligonucleotide
  Target: FXN; (-) strand; PAM type: YTN; PAM sequence: CTG
gaagacaaaacaaatgcata

SEQ ID NO: 28664 - DNA, 20 bp, Artificial Sequence
  Description of Artificial Sequence: Synthetic oligonucleotide
  Target: FXN; (-) strand; PAM type: YTN; PAM sequence: TTA
ggtccactggaagacaaaac

SEQ ID NO: 28665 - DNA, 20 bp, Artificial Sequence
  Description of Artificial Sequence: Synthetic oligonucleotide
  Target: FXN; (-) strand; PAM type: YTN; PAM sequence: CTT
aggtccactggaagacaaaa

SEQ ID NO: 28666 - DNA, 20 bp, Artificial Sequence
  Description of Artificial Sequence: Synthetic oligonucleotide
  Target: FXN; (-) strand; PAM type: YTN; PAM sequence: TTC
ccagtccagtcataacgctt

SEQ ID NO: 28667 - DNA, 20 bp, Artificial Sequence
  Description of Artificial Sequence: Synthetic oligonucleotide
  Target: FXN; (-) strand; PAM type: YTN; PAM sequence: TTT
cccagtccagtcataacgct

SEQ ID NO: 28668 - DNA, 20 bp, Artificial Sequence
  Description of Artificial Sequence: Synthetic oligonucleotide
  Target: FXN; (-) strand; PAM type: YTN; PAM sequence: TTT
tcccagtccagtcataacgc

SEQ ID NO: 28669 - DNA, 20 bp, Artificial Sequence
  Description of Artificial Sequence: Synthetic oligonucleotide
  Target: FXN; (-) strand; PAM type: YTN; PAM sequence: TTT
ttcccagtccagtcataacg

SEQ ID NO: 28670 - DNA, 20 bp, Artificial Sequence
  Description of Artificial Sequence: Synthetic oligonucleotide
  Target: FXN; (-) strand; PAM type: YTN; PAM sequence: CTC
atggagggacacgccgtcgt

SEQ ID NO: 28671 - DNA, 20 bp, Artificial Sequence
  Description of Artificial Sequence: Synthetic oligonucleotide
  Target: FXN; (-) strand; PAM type: YTN; PAM sequence: CTG
cggccagcagctcatggagg

SEQ ID NO: 28672 - DNA, 20 bp, Artificial Sequence
  Description of Artificial Sequence: Synthetic oligonucleotide
  Target: FXN; (-) strand; PAM type: YTN; PAM sequence: CTC
tgcggccagcagctcatgga

SEQ ID NO: 28673 - DNA, 20 bp, Artificial Sequence
  Description of Artificial Sequence: Synthetic oligonucleotide
  Target: FXN; (-) strand; PAM type: YTN; PAM sequence: TTA
gtgagctctgcggccagcag

SEQ ID NO: 28674 - DNA, 20 bp, Artificial Sequence
  Description of Artificial Sequence: Synthetic oligonucleotide
  Target: FXN; (-) strand; PAM type: YTN; PAM sequence: TTT
agtgagctctgcggccagca

SEQ ID NO: 28675 - DNA, 20 bp, Artificial Sequence
  Description of Artificial Sequence: Synthetic oligonucleotide
  Target: FXN; (-) strand; PAM type: YTN; PAM sequence: CTT
tagtgagctctgcggccagc

SEQ ID NO: 28676 - DNA, 20 bp, Artificial Sequence
  Description of Artificial Sequence: Synthetic oligonucleotide
  Target: FXN; (-) strand; PAM type: YTN; PAM sequence: TTA
aggctttagtgagctctgcg

SEQ ID NO: 28677 - DNA, 20 bp, Artificial Sequence
  Description of Artificial Sequence: Synthetic oligonucleotide
  Target: FXN; (-) strand; PAM type: YTN; PAM sequence: TTT
aaggctttagtgagctctgc

SEQ ID NO: 28678 - DNA, 20 bp, Artificial Sequence
  Description of Artificial Sequence: Synthetic oligonucleotide
  Target: FXN; (-) strand; PAM type: YTN; PAM sequence: TTT
taaggctttagtgagctctg

SEQ ID NO: 28679 - DNA, 20 bp, Artificial Sequence
  Description of Artificial Sequence: Synthetic oligonucleotide
  Target: FXN; (-) strand; PAM type: YTN; PAM sequence: TTT
ttaaggctttagtgagctct

SEQ ID NO: 28680 - DNA, 20 bp, Artificial Sequence
  Description of Artificial Sequence: Synthetic oligonucleotide
  Target: FXN; (-) strand; PAM type: YTN; PAM sequence: TTG
gtttttaaggctttagtgag

SEQ ID NO: 28681 - DNA, 20 bp, Artificial Sequence
  Description of Artificial Sequence: Synthetic oligonucleotide
  Target: FXN; (-) strand; PAM type: YTN; PAM sequence: TTT
ggtttttaaggctttagtga

SEQ ID NO: 28682 - DNA, 20 bp, Artificial Sequence
  Description of Artificial Sequence: Synthetic oligonucleotide
  Target: FXN; (-) strand; PAM type: YTN; PAM sequence: TTC
cggaataggccaaggaagac

SEQ ID NO: 28683 - DNA, 20 bp, Artificial Sequence
  Description of Artificial Sequence: Synthetic oligonucleotide
  Target: FXN; (-) strand; PAM type: YTN; PAM sequence: TTT
ccggaataggccaaggaaga

SEQ ID NO: 28684 - DNA, 20 bp, Artificial Sequence
  Description of Artificial Sequence: Synthetic oligonucleotide
  Target: FXN; (-) strand; PAM type: YTN; PAM sequence: TTT
tccggaataggccaaggaag

SEQ ID NO: 28685 - DNA, 20 bp, Artificial Sequence
  Description of Artificial Sequence: Synthetic oligonucleotide
  Target: FXN; (-) strand; PAM type: YTN; PAM sequence: CTT
ttccggaataggccaaggaa

SEQ ID NO: 28686 - DNA, 20 bp, Artificial Sequence
  Description of Artificial Sequence: Synthetic oligonucleotide
  Target: FXN; (-) strand; PAM type: YTN; PAM sequence: CTG
ggcatcaagcatcttttccg

SEQ ID NO: 28687 - DNA, 20 bp, Artificial Sequence
  Description of Artificial Sequence: Synthetic oligonucleotide
  Target: FXN; (-) strand; PAM type: YTN; PAM sequence: TTA
aaacggggctgggcatcaag

SEQ ID NO: 28688 - DNA, 20 bp, Artificial Sequence
  Description of Artificial Sequence: Synthetic oligonucleotide
  Target: FXN; (-) strand; PAM type: YTN; PAM sequence: CTT
aaaacggggctgggcatcaa

SEQ ID NO: 28689 - DNA, 20 bp, Artificial Sequence
  Description of Artificial Sequence: Synthetic oligonucleotide
  Target: FXN; (-) strand; PAM type: YTN; PAM sequence: TTA
atgtccttaaaacggggctg

SEQ ID NO: 28690 - DNA, 20 bp, Artificial Sequence
  Description of Artificial Sequence: Synthetic oligonucleotide
  Target: FXN; (-) strand; PAM type: YTN; PAM sequence: TTT
aatgtccttaaaacggggct

SEQ ID NO: 28691 - DNA, 20 bp, Artificial Sequence
  Description of Artificial Sequence: Synthetic oligonucleotide
  Target: FXN; (-) strand; PAM type: YTN; PAM sequence: TTT
taatgtccttaaaacggggc

SEQ ID NO: 28692 - DNA, 20 bp, Artificial Sequence
  Description of Artificial Sequence: Synthetic oligonucleotide
  Target: FXN; (-) strand; PAM type: YTN; PAM sequence: CTT
ttaatgtccttaaaacgggg

SEQ ID NO: 28693 - DNA, 20 bp, Artificial Sequence
  Description of Artificial Sequence: Synthetic oligonucleotide
  Target: FXN; (-) strand; PAM type: YTN; PAM sequence: CTG
atagcttttaatgtccttaa

SEQ ID NO: 28694 - DNA, 20 bp, Artificial Sequence
  Description of Artificial Sequence: Synthetic oligonucleotide
  Target: FXN; (-) strand; PAM type: YTN; PAM sequence: TTG
gcctgatagcttttaatgtc

SEQ ID NO: 28695 - DNA, 20 bp, Artificial Sequence
  Description of Artificial Sequence: Synthetic oligonucleotide
  Target: FXN; (-) strand; PAM type: YTN; PAM sequence: CTT
ggcctgatagcttttaatgt

SEQ ID NO: 28696 - DNA, 20 bp, Artificial Sequence
  Description of Artificial Sequence: Synthetic oligonucleotide
  Target: FXN; (-) strand; PAM type: YTN; PAM sequence: CTG
gggtcttggcctgatagctt

SEQ ID NO: 28697 - DNA, 20 bp, Artificial Sequence
  Description of Artificial Sequence: Synthetic oligonucleotide
  Target: FXN; (-) strand; PAM type: YTN; PAM sequence: CTG
cataatgaagctggggtctt

SEQ ID NO: 28698 - DNA, 20 bp, Artificial Sequence
  Description of Artificial Sequence: Synthetic oligonucleotide
  Target: FXN; (-) strand; PAM type: YTN; PAM sequence: CTC
agctgcataatgaagctggg

SEQ ID NO: 28699 - DNA, 20 bp, Artificial Sequence
  Description of Artificial Sequence: Synthetic oligonucleotide
  Target: FXN; (-) strand; PAM type: YTN; PAM sequence: CTC
aaaagcaggaataaaaaaaa

SEQ ID NO: 28700 - DNA, 20 bp, Artificial Sequence
  Description of Artificial Sequence: Synthetic oligonucleotide
  Target: FXN; (-) strand; PAM type: YTN; PAM sequence: CTG
tcctcaaaagcaggaataaa

SEQ ID NO: 28701 - DNA, 20 bp, Artificial Sequence
  Description of Artificial Sequence: Synthetic oligonucleotide
  Target: FXN; (-) strand; PAM type: YTN; PAM sequence: CTG
tgacacatagcccaactgtc

SEQ ID NO: 28702 - DNA, 20 bp, Artificial Sequence
  Description of Artificial Sequence: Synthetic oligonucleotide
  Target: FXN; (-) strand; PAM type: YTN; PAM sequence: CTA
cagagctgtgacacatagcc

SEQ ID NO: 28703 - DNA, 20 bp, Artificial Sequence
  Description of Artificial Sequence: Synthetic oligonucleotide
  Target: FXN; (-) strand; PAM type: YTN; PAM sequence: TTC
tacagagctgtgacacatag

SEQ ID NO: 28704 - DNA, 20 bp, Artificial Sequence
  Description of Artificial Sequence: Synthetic oligonucleotide
  Target: FXN; (-) strand; PAM type: YTN; PAM sequence: TTT
ctacagagctgtgacacata

SEQ ID NO: 28705 - DNA, 20 bp, Artificial Sequence
  Description of Artificial Sequence: Synthetic oligonucleotide
  Target: FXN; (-) strand; PAM type: YTN; PAM sequence: CTT
tctacagagctgtgacacat

SEQ ID NO: 28706 - DNA, 20 bp, Artificial Sequence
  Description of Artificial Sequence: Synthetic oligonucleotide
  Target: FXN; (-) strand; PAM type: YTN; PAM sequence: TTC
tttctacagagctgtgacac

SEQ ID NO: 28707 - DNA, 20 bp, Artificial Sequence
  Description of Artificial Sequence: Synthetic oligonucleotide
  Target: FXN; (-) strand; PAM type: YTN; PAM sequence: TTG
ggggcaaggtaggaggcaac

SEQ ID NO: 28708 - DNA, 20 bp, Artificial Sequence
  Description of Artificial Sequence: Synthetic oligonucleotide
  Target: FXN; (-) strand; PAM type: YTN; PAM sequence: CTT
gggggcaaggtaggaggcaa

SEQ ID NO: 28709 - DNA, 20 bp, Artificial Sequence
  Description of Artificial Sequence: Synthetic oligonucleotide
  Target: FXN; (-) strand; PAM type: YTN; PAM sequence: TTA
aaaatcagaacttgggggca

SEQ ID NO: 28710 - DNA, 20 bp, Artificial Sequence
  Description of Artificial Sequence: Synthetic oligonucleotide
  Target: FXN; (-) strand; PAM type: YTN; PAM sequence: TTC
catagaaattaaaaatcaga

SEQ ID NO: 28711 - DNA, 20 bp, Artificial Sequence
  Description of Artificial Sequence: Synthetic oligonucleotide
  Target: FXN; (-) strand; PAM type: YTN; PAM sequence: CTT
ccatagaaattaaaaatcag

SEQ ID NO: 28712 - DNA, 20 bp, Artificial Sequence
  Description of Artificial Sequence: Synthetic oligonucleotide
  Target: FXN; (-) strand; PAM type: YTN; PAM sequence: TTA
taaaagataaggggtatcat

SEQ ID NO: 28713 - DNA, 20 bp, Artificial Sequence
  Description of Artificial Sequence: Synthetic oligonucleotide
  Target: FXN; (-) strand; PAM type: YTN; PAM sequence: TTC
aggtataggcataagacatt

SEQ ID NO: 28714 - DNA, 20 bp, Artificial Sequence
  Description of Artificial Sequence: Synthetic oligonucleotide
  Target: FXN; (-) strand; PAM type: YTN; PAM sequence: TTA
tattcaggtataggcataag

SEQ ID NO: 28715 - DNA, 20 bp, Artificial Sequence
  Description of Artificial Sequence: Synthetic oligonucleotide
  Target: FXN; (-) strand; PAM type: YTN; PAM sequence: TTG
ttatattcaggtataggcat

SEQ ID NO: 28716 - DNA, 20 bp, Artificial Sequence
  Description of Artificial Sequence: Synthetic oligonucleotide
  Target: FXN; (-) strand; PAM type: YTN; PAM sequence: TTA
aaggttgttatattcaggta

SEQ ID NO: 28717 - DNA, 20 bp, Artificial Sequence
  Description of Artificial Sequence: Synthetic oligonucleotide
  Target: FXN; (-) strand; PAM type: YTN; PAM sequence: TTT
aaaggttgttatattcaggt

SEQ ID NO: 28718 - DNA, 20 bp, Artificial Sequence
  Description of Artificial Sequence: Synthetic oligonucleotide
  Target: FXN; (-) strand; PAM type: YTN; PAM sequence: TTT
taaaggttgttatattcagg

SEQ ID NO: 28719 - DNA, 20 bp, Artificial Sequence
  Description of Artificial Sequence: Synthetic oligonucleotide
  Target: FXN; (-) strand; PAM type: YTN; PAM sequence: TTT
ttaaaggttgttatattcag

SEQ ID NO: 28720 - DNA, 20 bp, Artificial Sequence
  Description of Artificial Sequence: Synthetic oligonucleotide
  Target: FXN; (-) strand; PAM type: YTN; PAM sequence: TTT
tttaaaggttgttatattca

SEQ ID NO: 28721 - DNA, 20 bp, Artificial Sequence
  Description of Artificial Sequence: Synthetic oligonucleotide
  Target: FXN; (-) strand; PAM type: YTN; PAM sequence: CTT
ttttaaaggttgttatattc

SEQ ID NO: 28722 - DNA, 20 bp, Artificial Sequence
  Description of Artificial Sequence: Synthetic oligonucleotide
  Target: FXN; (-) strand; PAM type: YTN; PAM sequence: TTG
cttttttaaaggttgttata

SEQ ID NO: 28723 - DNA, 20 bp, Artificial Sequence
  Description of Artificial Sequence: Synthetic oligonucleotide
  Target: FXN; (-) strand; PAM type: YTN; PAM sequence: TTT
gcttttttaaaggttgttat

SEQ ID NO: 28724 - DNA, 20 bp, Artificial Sequence
  Description of Artificial Sequence: Synthetic oligonucleotide
  Target: FXN; (-) strand; PAM type: YTN; PAM sequence: TTT
tgcttttttaaaggttgtta

SEQ ID NO: 28725 - DNA, 20 bp, Artificial Sequence
  Description of Artificial Sequence: Synthetic oligonucleotide
  Target: FXN; (-) strand; PAM type: YTN; PAM sequence: TTA
ttttgcttttttaaaggttg

SEQ ID NO: 28726 - DNA, 20 bp, Artificial Sequence
  Description of Artificial Sequence: Synthetic oligonucleotide
  Target: FXN; (-) strand; PAM type: YTN; PAM sequence: TTA
ttattttgcttttttaaagg

SEQ ID NO: 28727 - DNA, 20 bp, Artificial Sequence
  Description of Artificial Sequence: Synthetic oligonucleotide
  Target: FXN; (-) strand; PAM type: YTN; PAM sequence: CTT
attattttgcttttttaaag

SEQ ID NO: 28728 - DNA, 20 bp, Artificial Sequence
  Description of Artificial Sequence: Synthetic oligonucleotide
  Target: FXN; (-) strand; PAM type: YTN; PAM sequence: TTC
ttattattttgcttttttaa

SEQ ID NO: 28729 - DNA, 20 bp, Artificial Sequence
  Description of Artificial Sequence: Synthetic oligonucleotide
  Target: FXN; (-) strand; PAM type: YTN; PAM sequence: CTT
cttattattttgctttttta

SEQ ID NO: 28730 - DNA, 20 bp, Artificial Sequence
  Description of Artificial Sequence: Synthetic oligonucleotide
  Target: FXN; (-) strand; PAM type: YTN; PAM sequence: TTC
cttcttattattttgctttt

SEQ ID NO: 28731 - DNA, 20 bp, Artificial Sequence
  Description of Artificial Sequence: Synthetic oligonucleotide
  Target: FXN; (-) strand; PAM type: YTN; PAM sequence: TTT
ccttcttattattttgcttt

SEQ ID NO: 28732 - DNA, 20 bp, Artificial Sequence
  Description of Artificial Sequence: Synthetic oligonucleotide
  Target: FXN; (-) strand; PAM type: YTN; PAM sequence: TTT
tccttcttattattttgctt

SEQ ID NO: 28733 - DNA, 20 bp, Artificial Sequence
  Description of Artificial Sequence: Synthetic oligonucleotide
  Target: FXN; (-) strand; PAM type: YTN; PAM sequence: TTT
ttccttcttattattttgct

SEQ ID NO: 28734 - DNA, 20 bp, Artificial Sequence
  Description of Artificial Sequence: Synthetic oligonucleotide
  Target: FXN; (-) strand; PAM type: YTN; PAM sequence: CTG
gaatttttccttcttattat

SEQ ID NO: 28735 - DNA, 20 bp, Artificial Sequence
  Description of Artificial Sequence: Synthetic oligonucleotide
  Target: FXN; (-) strand; PAM type: YTN; PAM sequence: CTC
ctggaatttttccttcttat

SEQ ID NO: 28736 - DNA, 20 bp, Artificial Sequence
  Description of Artificial Sequence: Synthetic oligonucleotide
  Target: FXN; (-) strand; PAM type: YTN; PAM sequence: TTC
cctcctggaatttttccttc

SEQ ID NO: 28737 - DNA, 20 bp, Artificial Sequence
  Description of Artificial Sequence: Synthetic oligonucleotide
  Target: FXN; (-) strand; PAM type: YTN; PAM sequence: TTT
ccctcctggaatttttcctt

SEQ ID NO: 28738 - DNA, 20 bp, Artificial Sequence
  Description of Artificial Sequence: Synthetic oligonucleotide
  Target: FXN; (-) strand; PAM type: YTN; PAM sequence: TTT
tccctcctggaatttttcct

SEQ ID NO: 28739 - DNA, 20 bp, Artificial Sequence
  Description of Artificial Sequence: Synthetic oligonucleotide
  Target: FXN; (-) strand; PAM type: YTN; PAM sequence: TTC
attttccctcctggaatttt

SEQ ID NO: 28740 - DNA, 20 bp, Artificial Sequence
  Description of Artificial Sequence: Synthetic oligonucleotide
  Target: FXN; (-) strand; PAM type: YTN; PAM sequence: TTC
aaagaatgaagagtgaagac

SEQ ID NO: 28741 - DNA, 20 bp, Artificial Sequence
  Description of Artificial Sequence: Synthetic oligonucleotide
  Target: FXN; (-) strand; PAM type: YTN; PAM sequence: CTT
caaagaatgaagagtgaaga

SEQ ID NO: 28742 - DNA, 20 bp, Artificial Sequence
  Description of Artificial Sequence: Synthetic oligonucleotide
  Target: FXN; (-) strand; PAM type: YTN; PAM sequence: TTG
cagtaaatccttcaaagaat

SEQ ID NO: 28743 - DNA, 20 bp, Artificial Sequence
  Description of Artificial Sequence: Synthetic oligonucleotide
  Target: FXN; (-) strand; PAM type: YTN; PAM sequence: CTT
gcagtaaatccttcaaagaa

SEQ ID NO: 28744 - DNA, 20 bp, Artificial Sequence
  Description of Artificial Sequence: Synthetic oligonucleotide
  Target: FXN; (-) strand; PAM type: YTN; PAM sequence: TTC
ttgcagtaaatccttcaaag

SEQ ID NO: 28745 - DNA, 20 bp, Artificial Sequence
  Description of Artificial Sequence: Synthetic oligonucleotide
  Target: FXN; (-) strand; PAM type: YTN; PAM sequence: CTT
cttgcagtaaatccttcaaa

SEQ ID NO: 28746 - DNA, 20 bp, Artificial Sequence
  Description of Artificial Sequence: Synthetic oligonucleotide
  Target: FXN; (-) strand; PAM type: YTN; PAM sequence: TTC
atgtacttcttgcagtaaat

SEQ ID NO: 28747 - DNA, 20 bp, Artificial Sequence
  Description of Artificial Sequence: Synthetic oligonucleotide
  Target: FXN; (-) strand; PAM type: YTN; PAM sequence: CTT
catgtacttcttgcagtaaa

SEQ ID NO: 28748 - DNA, 20 bp, Artificial Sequence
  Description of Artificial Sequence: Synthetic oligonucleotide
  Target: FXN; (-) strand; PAM type: YTN; PAM sequence: CTC
ttcatgtacttcttgcagta

SEQ ID NO: 28749 - DNA, 20 bp, Artificial Sequence
  Description of Artificial Sequence: Synthetic oligonucleotide
  Target: FXN; (-) strand; PAM type: YTN; PAM sequence: CTG
ctcttcatgtacttcttgca

SEQ ID NO: 28750 - DNA, 20 bp, Artificial Sequence
  Description of Artificial Sequence: Synthetic oligonucleotide
  Target: FXN; (-) strand; PAM type: YTN; PAM sequence: TTG
accagctgctcttcatgtac

SEQ ID NO: 28751 - DNA, 20 bp, Artificial Sequence
  Description of Artificial Sequence: Synthetic oligonucleotide
  Target: FXN; (-) strand; PAM type: YTN; PAM sequence: TTG
gagatagaacagtgagcagg

SEQ ID NO: 28752 - DNA, 20 bp, Artificial Sequence
  Description of Artificial Sequence: Synthetic oligonucleotide
  Target: FXN; (-) strand; PAM type: YTN; PAM sequence: TTT
ggagatagaacagtgagcag

SEQ ID NO: 28753 - DNA, 20 bp, Artificial Sequence
  Description of Artificial Sequence: Synthetic oligonucleotide
  Target: FXN; (-) strand; PAM type: YTN; PAM sequence: CTC
atttggagatagaacagtga

SEQ ID NO: 28754 - DNA, 20 bp, Artificial Sequence
  Description of Artificial Sequence: Synthetic oligonucleotide
  Target: FXN; (-) strand; PAM type: YTN; PAM sequence: TTA
atgtgtctcatttggagata

SEQ ID NO: 28755 - DNA, 20 bp, Artificial Sequence
  Description of Artificial Sequence: Synthetic oligonucleotide
  Target: FXN; (-) strand; PAM type: YTN; PAM sequence: TTT
aatgtgtctcatttggagat

SEQ ID NO: 28756 - DNA, 20 bp, Artificial Sequence
  Description of Artificial Sequence: Synthetic oligonucleotide
  Target: FXN; (-) strand; PAM type: YTN; PAM sequence: CTT
taatgtgtctcatttggaga

SEQ ID NO: 28757 - DNA, 20 bp, Artificial Sequence
  Description of Artificial Sequence: Synthetic oligonucleotide
  Target: FXN; (-) strand; PAM type: YTN; PAM sequence: CTA
ccctttaatgtgtctcattt

SEQ ID NO: 28758 - DNA, 20 bp, Artificial Sequence
  Description of Artificial Sequence: Synthetic oligonucleotide
  Target: FXN; (-) strand; PAM type: YTN; PAM sequence: TTG
taggctaccctttaatgtgt

SEQ ID NO: 28759 - DNA, 20 bp, Artificial Sequence
  Description of Artificial Sequence: Synthetic oligonucleotide
  Target: FXN; (-) strand; PAM type: YTN; PAM sequence: TTT
gtaggctaccctttaatgtg

SEQ ID NO: 28760 - DNA, 20 bp, Artificial Sequence
  Description of Artificial Sequence: Synthetic oligonucleotide
  Target: FXN; (-) strand; PAM type: YTN; PAM sequence: CTG
aaaacatttgtaggctaccc

SEQ ID NO: 28761 - DNA, 20 bp, Artificial Sequence
  Description of Artificial Sequence: Synthetic oligonucleotide
  Target: FXN; (-) strand; PAM type: YTN; PAM sequence: TTG
aaagaagcctgaaaacattt

SEQ ID NO: 28762 - DNA, 20 bp, Artificial Sequence
  Description of Artificial Sequence: Synthetic oligonucleotide
  Target: FXN; (-) strand; PAM type: YTN; PAM sequence: TTT
gaaagaagcctgaaaacatt

SEQ ID NO: 28763 - DNA, 20 bp, Artificial Sequence
  Description of Artificial Sequence: Synthetic oligonucleotide
  Target: FXN; (-) strand; PAM type: YTN; PAM sequence: CTT
tgaaagaagcctgaaaacat

SEQ ID NO: 28764 - DNA, 20 bp, Artificial Sequence
  Description of Artificial Sequence: Synthetic oligonucleotide
  Target: FXN; (-) strand; PAM type: YTN; PAM sequence: TTA
cactttgaaagaagcctgaa

SEQ ID NO: 28765 - DNA, 20 bp, Artificial Sequence
  Description of Artificial Sequence: Synthetic oligonucleotide
  Target: FXN; (-) strand; PAM type: YTN; PAM sequence: CTT
acactttgaaagaagcctga

SEQ ID NO: 28766 - DNA, 20 bp, Artificial Sequence
  Description of Artificial Sequence: Synthetic oligonucleotide
  Target: FXN; (-) strand; PAM type: YTN; PAM sequence: CTC
agaagtgcttacactttgaa

SEQ ID NO: 28767 - DNA, 20 bp, Artificial Sequence
  Description of Artificial Sequence: Synthetic oligonucleotide
  Target: FXN; (-) strand; PAM type: YTN; PAM sequence: CTA
aagagctcagaagtgcttac

SEQ ID NO: 28768 - DNA, 20 bp, Artificial Sequence
  Description of Artificial Sequence: Synthetic oligonucleotide
  Target: FXN; (-) strand; PAM type: YTN; PAM sequence: TTC
aatgctaaagagctcagaag

SEQ ID NO: 28769 - DNA, 20 bp, Artificial Sequence
  Description of Artificial Sequence: Synthetic oligonucleotide
  Target: FXN; (-) strand; PAM type: YTN; PAM sequence: CTT
caatgctaaagagctcagaa

SEQ ID NO: 28770 - DNA, 20 bp, Artificial Sequence
  Description of Artificial Sequence: Synthetic oligonucleotide
  Target: FXN; (-) strand; PAM type: YTN; PAM sequence: TTC
gacacttcaatgctaaagag

SEQ ID NO: 28771 - DNA, 20 bp, Artificial Sequence
  Description of Artificial Sequence: Synthetic oligonucleotide
  Target: FXN; (-) strand; PAM type: YTN; PAM sequence: TTT
cgacacttcaatgctaaaga

SEQ ID NO: 28772 - DNA, 20 bp, Artificial Sequence
  Description of Artificial Sequence: Synthetic oligonucleotide
  Target: FXN; (-) strand; PAM type: YTN; PAM sequence: CTT
tcgacacttcaatgctaaag

SEQ ID NO: 28773 - DNA, 20 bp, Artificial Sequence
  Description of Artificial Sequence: Synthetic oligonucleotide
  Target: FXN; (-) strand; PAM type: YTN; PAM sequence: TTG
ctttcgacacttcaatgcta

SEQ ID NO: 28774 - DNA, 20 bp, Artificial Sequence
  Description of Artificial Sequence: Synthetic oligonucleotide
  Target: FXN; (-) strand; PAM type: YTN; PAM sequence: TTC
ccgtgtgagttgctttcgac

SEQ ID NO: 28775 - DNA, 20 bp, Artificial Sequence
  Description of Artificial Sequence: Synthetic oligonucleotide
  Target: FXN; (-) strand; PAM type: YTN; PAM sequence: CTT
cccgtgtgagttgctttcga

SEQ ID NO: 28776 - DNA, 20 bp, Artificial Sequence
  Description of Artificial Sequence: Synthetic oligonucleotide
  Target: FXN; (-) strand; PAM type: YTN; PAM sequence: TTG
gcagtcacagagcacaaata

SEQ ID NO: 28777 - DNA, 20 bp, Artificial Sequence
  Description of Artificial Sequence: Synthetic oligonucleotide
  Target: FXN; (-) strand; PAM type: YTN; PAM sequence: CTT
ggcagtcacagagcacaaat

SEQ ID NO: 28778 - DNA, 20 bp, Artificial Sequence
  Description of Artificial Sequence: Synthetic oligonucleotide
  Target: FXN; (-) strand; PAM type: YTN; PAM sequence: CTG
gacaacccagtgcaggccac

SEQ ID NO: 28779 - DNA, 20 bp, Artificial Sequence
  Description of Artificial Sequence: Synthetic oligonucleotide
  Target: FXN; (-) strand; PAM type: YTN; PAM sequence: CTC
cctggacaacccagtgcagg

SEQ ID NO: 28780 - DNA, 20 bp, Artificial Sequence
  Description of Artificial Sequence: Synthetic oligonucleotide
  Target: FXN; (-) strand; PAM type: YTN; PAM sequence: CTA
ggtctccctggacaacccag

SEQ ID NO: 28781 - DNA, 20 bp, Artificial Sequence
  Description of Artificial Sequence: Synthetic oligonucleotide
  Target: FXN; (-) strand; PAM type: YTN; PAM sequence: TTG
aaaaaatatatatacacaca

SEQ ID NO: 28782 - DNA, 20 bp, Artificial Sequence
  Description of Artificial Sequence: Synthetic oligonucleotide
  Target: FXN; (-) strand; PAM type: YTN; PAM sequence: TTA
aattgaaaaaatatatatac

SEQ ID NO: 28783 - DNA, 20 bp, Artificial Sequence
  Description of Artificial Sequence: Synthetic oligonucleotide
  Target: FXN; (-) strand; PAM type: YTN; PAM sequence: TTT
aaattgaaaaaatatatata

SEQ ID NO: 28784 - DNA, 20 bp, Artificial Sequence
  Description of Artificial Sequence: Synthetic oligonucleotide
  Target: FXN; (-) strand; PAM type: YTN; PAM sequence: CTT
taaattgaaaaaatatatat

SEQ ID NO: 28785 - DNA, 20 bp, Artificial Sequence
  Description of Artificial Sequence: Synthetic oligonucleotide
  Target: FXN; (-) strand; PAM type: YTN; PAM sequence: CTA
acctttaaattgaaaaaata

SEQ ID NO: 28786 - DNA, 20 bp, Artificial Sequence
  Description of Artificial Sequence: Synthetic oligonucleotide
  Target: FXN; (-) strand; PAM type: YTN; PAM sequence: TTC
catactaacctttaaattga

SEQ ID NO: 28787 - DNA, 20 bp, Artificial Sequence
  Description of Artificial Sequence: Synthetic oligonucleotide
  Target: FXN; (-) strand; PAM type: YTN; PAM sequence: CTG
attccatactaacctttaaa

SEQ ID NO: 28788 - DNA, 20 bp, Artificial Sequence
  Description of Artificial Sequence: Synthetic oligonucleotide
  Target: FXN; (-) strand; PAM type: YTN; PAM sequence: TTG
tagcagctgattccatacta

SEQ ID NO: 28789 - DNA, 20 bp, Artificial Sequence
  Description of Artificial Sequence: Synthetic oligonucleotide
  Target: FXN; (-) strand; PAM type: YTN; PAM sequence: CTT
gtagcagctgattccatact

SEQ ID NO: 28790 - DNA, 20 bp, Artificial Sequence
  Description of Artificial Sequence: Synthetic oligonucleotide
  Target: FXN; (-) strand; PAM type: YTN; PAM sequence: TTC
ttgtagcagctgattccata

SEQ ID NO: 28791 - DNA, 20 bp, Artificial Sequence
  Description of Artificial Sequence: Synthetic oligonucleotide
  Target: FXN; (-) strand; PAM type: YTN; PAM sequence: TTG
cattcttgtagcagctgatt

SEQ ID NO: 28792 - DNA, 20 bp, Artificial Sequence
  Description of Artificial Sequence: Synthetic oligonucleotide
  Target: FXN; (-) strand; PAM type: YTN; PAM sequence: TTT
gcattcttgtagcagctgat

SEQ ID NO: 28793 - DNA, 20 bp, Artificial Sequence
  Description of Artificial Sequence: Synthetic oligonucleotide
  Target: FXN; (-) strand; PAM type: YTN; PAM sequence: TTT
tgcattcttgtagcagctga

SEQ ID NO: 28794 - DNA, 20 bp, Artificial Sequence
  Description of Artificial Sequence: Synthetic oligonucleotide
  Target: FXN; (-) strand; PAM type: YTN; PAM sequence: TTT
ttgcattcttgtagcagctg

SEQ ID NO: 28795 - DNA, 20 bp, Artificial Sequence
  Description of Artificial Sequence: Synthetic oligonucleotide
  Target: FXN; (-) strand; PAM type: YTN; PAM sequence: TTT
tttgcattcttgtagcagct

SEQ ID NO: 28796 - DNA, 20 bp, Artificial Sequence
  Description of Artificial Sequence: Synthetic oligonucleotide
  Target: FXN; (-) strand; PAM type: YTN; PAM sequence: TTG
gaagattttttgcattcttg

SEQ ID NO: 28797 - DNA, 20 bp, Artificial Sequence
  Description of Artificial Sequence: Synthetic oligonucleotide
  Target: FXN; (-) strand; PAM type: YTN; PAM sequence: TTT
ggaagattttttgcattctt

SEQ ID NO: 28798 - DNA, 20 bp, Artificial Sequence
  Description of Artificial Sequence: Synthetic oligonucleotide
  Target: FXN; (-) strand; PAM type: YTN; PAM sequence: CTT
tggaagattttttgcattct

SEQ ID NO: 28799 - DNA, 20 bp, Artificial Sequence
  Description of Artificial Sequence: Synthetic oligonucleotide
  Target: FXN; (-) strand; PAM type: YTN; PAM sequence: TTG
tctttggaagattttttgca

SEQ ID NO: 28800 - DNA, 20 bp, Artificial Sequence
  Description of Artificial Sequence: Synthetic oligonucleotide
  Target: FXN; (-) strand; PAM type: YTN; PAM sequence: CTT
gtctttggaagattttttgc

SEQ ID NO: 28801 - DNA, 20 bp, Artificial Sequence
  Description of Artificial Sequence: Synthetic oligonucleotide
  Target: FXN; (-) strand; PAM type: YTN; PAM sequence: TTC
ttgtctttggaagatttttt

SEQ ID NO: 28802 - DNA, 20 bp, Artificial Sequence
  Description of Artificial Sequence: Synthetic oligonucleotide
  Target: FXN; (-) strand; PAM type: YTN; PAM sequence: TTT
cttgtctttggaagattttt

SEQ ID NO: 28803 - DNA, 20 bp, Artificial Sequence
  Description of Artificial Sequence: Synthetic oligonucleotide
  Target: FXN; (-) strand; PAM type: YTN; PAM sequence: TTT
tcttgtctttggaagatttt

SEQ ID NO: 28804 - DNA, 20 bp, Artificial Sequence
  Description of Artificial Sequence: Synthetic oligonucleotide
  Target: FXN; (-) strand; PAM type: YTN; PAM sequence: CTT
ttcttgtctttggaagattt

SEQ ID NO: 28805 - DNA, 20 bp, Artificial Sequence
  Description of Artificial Sequence: Synthetic oligonucleotide
  Target: FXN; (-) strand; PAM type: YTN; PAM sequence: CTC
ttttcttgtctttggaagat

SEQ ID NO: 28806 - DNA, 20 bp, Artificial Sequence
  Description of Artificial Sequence: Synthetic oligonucleotide
  Target: FXN; (-) strand; PAM type: YTN; PAM sequence: TTC
ctcttttcttgtctttggaa

SEQ ID NO: 28807 - DNA, 20 bp, Artificial Sequence
  Description of Artificial Sequence: Synthetic oligonucleotide
  Target: FXN; (-) strand; PAM type: YTN; PAM sequence: TTT
cctcttttcttgtctttgga

SEQ ID NO: 28808 - DNA, 20 bp, Artificial Sequence
  Description of Artificial Sequence: Synthetic oligonucleotide
  Target: FXN; (-) strand; PAM type: YTN; PAM sequence: TTT
tcctcttttcttgtctttgg

SEQ ID NO: 28809 - DNA, 20 bp, Artificial Sequence
  Description of Artificial Sequence: Synthetic oligonucleotide
  Target: FXN; (-) strand; PAM type: YTN; PAM sequence: TTT
ttcctcttttcttgtctttg

SEQ ID NO: 28810 - DNA, 20 bp, Artificial Sequence
  Description of Artificial Sequence: Synthetic oligonucleotide
  Target: FXN; (-) strand; PAM type: YTN; PAM sequence: TTT
tttcctcttttcttgtcttt

SEQ ID NO: 28811 - DNA, 20 bp, Artificial Sequence
  Description of Artificial Sequence: Synthetic oligonucleotide
  Target: FXN; (-) strand; PAM type: YTN; PAM sequence: TTT
ttttcctcttttcttgtctt

SEQ ID NO: 28812 - DNA, 20 bp, Artificial Sequence
  Description of Artificial Sequence: Synthetic oligonucleotide
  Target: FXN; (-) strand; PAM type: YTN; PAM sequence: CTT
tttttcctcttttcttgtct

SEQ ID NO: 28813 - DNA, 20 bp, Artificial Sequence
  Description of Artificial Sequence: Synthetic oligonucleotide
  Target: FXN; (-) strand; PAM type: YTN; PAM sequence: CTC
atgaaaacggctttttttcc

SEQ ID NO: 28814 - DNA, 20 bp, Artificial Sequence
  Description of Artificial Sequence: Synthetic oligonucleotide
  Target: FXN; (-) strand; PAM type: YTN; PAM sequence: CTC
agctcatgaaaacggctttt

SEQ ID NO: 28815 - DNA, 20 bp, Artificial Sequence
  Description of Artificial Sequence: Synthetic oligonucleotide
  Target: FXN; (-) strand; PAM type: YTN; PAM sequence: CTA
catcactcagctcatgaaaa

SEQ ID NO: 28816 - DNA, 20 bp, Artificial Sequence
  Description of Artificial Sequence: Synthetic oligonucleotide
  Target: FXN; (-) strand; PAM type: YTN; PAM sequence: TTA
cgctacatcactcagctcat

SEQ ID NO: 28817 - DNA, 20 bp, Artificial Sequence
  Description of Artificial Sequence: Synthetic oligonucleotide
  Target: FXN; (-) strand; PAM type: YTN; PAM sequence: TTG
ttacgctacatcactcagct

SEQ ID NO: 28818 - DNA, 20 bp, Artificial Sequence
  Description of Artificial Sequence: Synthetic oligonucleotide
  Target: FXN; (-) strand; PAM type: YTN; PAM sequence: TTT
gttacgctacatcactcagc

SEQ ID NO: 28819 - DNA, 20 bp, Artificial Sequence
  Description of Artificial Sequence: Synthetic oligonucleotide
  Target: FXN; (-) strand; PAM type: YTN; PAM sequence: TTG
tttgttacgctacatcactc

SEQ ID NO: 28820 - DNA, 20 bp, Artificial Sequence
  Description of Artificial Sequence: Synthetic oligonucleotide
  Target: FXN; (-) strand; PAM type: YTN; PAM sequence: TTT
gtttgttacgctacatcact

SEQ ID NO: 28821 - DNA, 20 bp, Artificial Sequence
  Description of Artificial Sequence: Synthetic oligonucleotide
  Target: FXN; (-) strand; PAM type: YTN; PAM sequence: TTT
tgtttgttacgctacatcac

SEQ ID NO: 28822 - DNA, 20 bp, Artificial Sequence
  Description of Artificial Sequence: Synthetic oligonucleotide
  Target: FXN; (-) strand; PAM type: YTN; PAM sequence: CTC
catgattttgtttgttacgc

SEQ ID NO: 28823 - DNA, 20 bp, Artificial Sequence
  Description of Artificial Sequence: Synthetic oligonucleotide
  Target: FXN; (-) strand; PAM type: YTN; PAM sequence: CTC
agctccatgattttgtttgt

SEQ ID NO: 28824 - DNA, 20 bp, Artificial Sequence
  Description of Artificial Sequence: Synthetic oligonucleotide
  Target: FXN; (-) strand; PAM type: YTN; PAM sequence: CTC
ctcagctccatgattttgtt

SEQ ID NO: 28825 - DNA, 20 bp, Artificial Sequence
  Description of Artificial Sequence: Synthetic oligonucleotide
  Target: FXN; (-) strand; PAM type: YTN; PAM sequence: TTA
caaggcacctcctcagctcc

SEQ ID NO: 28826 - DNA, 20 bp, Artificial Sequence
  Description of Artificial Sequence: Synthetic oligonucleotide
  Target: FXN; (-) strand; PAM type: YTN; PAM sequence: TTT
acaaggcacctcctcagctc

SEQ ID NO: 28827 - DNA, 20 bp, Artificial Sequence
  Description of Artificial Sequence: Synthetic oligonucleotide
  Target: FXN; (-) strand; PAM type: YTN; PAM sequence: TTC
atgtttacaaggcacctcct

SEQ ID NO: 28828 - DNA, 20 bp, Artificial Sequence
  Description of Artificial Sequence: Synthetic oligonucleotide
  Target: FXN; (-) strand; PAM type: YTN; PAM sequence: CTT
catgtttacaaggcacctcc

SEQ ID NO: 28829 - DNA, 20 bp, Artificial Sequence
  Description of Artificial Sequence: Synthetic oligonucleotide
  Target: FXN; (-) strand; PAM type: YTN; PAM sequence: CTG
ccccttcatgtttacaaggc

SEQ ID NO: 28830 - DNA, 20 bp, Artificial Sequence
  Description of Artificial Sequence: Synthetic oligonucleotide
  Target: FXN; (-) strand; PAM type: YTN; PAM sequence: TTA
tctgccccttcatgtttaca

SEQ ID NO: 28831 - DNA, 20 bp, Artificial Sequence
  Description of Artificial Sequence: Synthetic oligonucleotide
  Target: FXN; (-) strand; PAM type: YTN; PAM sequence: TTT
atctgccccttcatgtttac

SEQ ID NO: 28832 - DNA, 20 bp, Artificial Sequence
  Description of Artificial Sequence: Synthetic oligonucleotide
  Target: FXN; (-) strand; PAM type: YTN; PAM sequence: CTT
tatctgccccttcatgttta

SEQ ID NO: 28833 - DNA, 20 bp, Artificial Sequence
  Description of Artificial Sequence: Synthetic oligonucleotide
  Target: FXN; (-) strand; PAM type: YTN; PAM sequence: TTC
ctttatctgccccttcatgt

SEQ ID NO: 28834 - DNA, 20 bp, Artificial Sequence
  Description of Artificial Sequence: Synthetic oligonucleotide
  Target: FXN; (-) strand; PAM type: YTN; PAM sequence: CTT
cctttatctgccccttcatg

SEQ ID NO: 28835 - DNA, 20 bp, Artificial Sequence
  Description of Artificial Sequence: Synthetic oligonucleotide
  Target: FXN; (-) strand; PAM type: YTN; PAM sequence: CTC
cttcctttatctgccccttc

SEQ ID NO: 28836 - DNA, 20 bp, Artificial Sequence
  Description of Artificial Sequence: Synthetic oligonucleotide
  Target: FXN; (-) strand; PAM type: YTN; PAM sequence: TTA
tcaacatgagtatctccttc

SEQ ID NO: 28837 - DNA, 20 bp, Artificial Sequence
  Description of Artificial Sequence: Synthetic oligonucleotide
  Target: FXN; (-) strand; PAM type: YTN; PAM sequence: TTT
atcaacatgagtatctcctt

SEQ ID NO: 28838 - DNA, 20 bp, Artificial Sequence
  Description of Artificial Sequence: Synthetic oligonucleotide
  Target: FXN; (-) strand; PAM type: YTN; PAM sequence: CTT
tatcaacatgagtatctcct

SEQ ID NO: 28839 - DNA, 20 bp, Artificial Sequence
  Description of Artificial Sequence: Synthetic oligonucleotide
  Target: FXN; (-) strand; PAM type: YTN; PAM sequence: CTC
tttatcaacatgagtatctc

SEQ ID NO: 28840 - DNA, 20 bp, Artificial Sequence
  Description of Artificial Sequence: Synthetic oligonucleotide
  Target: FXN; (-) strand; PAM type: YTN; PAM sequence: CTC
tctttatcaacatgagtatc

SEQ ID NO: 28841 - DNA, 20 bp, Artificial Sequence
  Description of Artificial Sequence: Synthetic oligonucleotide
  Target: FXN; (-) strand; PAM type: YTN; PAM sequence: CTA
ggaccagggctctctttatc

SEQ ID NO: 28842 - DNA, 20 bp, Artificial Sequence
  Description of Artificial Sequence: Synthetic oligonucleotide
  Target: FXN; (-) strand; PAM type: YTN; PAM sequence: CTA
tgtctaggaccagggctctc

SEQ ID NO: 28843 - DNA, 20 bp, Artificial Sequence
  Description of Artificial Sequence: Synthetic oligonucleotide
  Target: FXN; (-) strand; PAM type: YTN; PAM sequence: CTG
aactatgtctaggaccaggg

SEQ ID NO: 28844 - DNA, 20 bp, Artificial Sequence
  Description of Artificial Sequence: Synthetic oligonucleotide
  Target: FXN; (-) strand; PAM type: YTN; PAM sequence: TTG
tggctgaactatgtctagga

SEQ ID NO: 28845 - DNA, 20 bp, Artificial Sequence
  Description of Artificial Sequence: Synthetic oligonucleotide
  Target: FXN; (-) strand; PAM type: YTN; PAM sequence: TTT
gtggctgaactatgtctagg

SEQ ID NO: 28846 - DNA, 20 bp, Artificial Sequence
  Description of Artificial Sequence: Synthetic oligonucleotide
  Target: FXN; (-) strand; PAM type: YTN; PAM sequence: CTT
tgtggctgaactatgtctag

SEQ ID NO: 28847 - DNA, 20 bp, Artificial Sequence
  Description of Artificial Sequence: Synthetic oligonucleotide
  Target: FXN; (-) strand; PAM type: YTN; PAM sequence: CTA
ctttgtggctgaactatgtc

SEQ ID NO: 28848 - DNA, 20 bp, Artificial Sequence
  Description of Artificial Sequence: Synthetic oligonucleotide
  Target: FXN; (-) strand; PAM type: YTN; PAM sequence: TTG
tccacaaagggacaactact

SEQ ID NO: 28849 - DNA, 20 bp, Artificial Sequence
  Description of Artificial Sequence: Synthetic oligonucleotide
  Target: FXN; (-) strand; PAM type: YTN; PAM sequence: CTT
gtccacaaagggacaactac

SEQ ID NO: 28850 - DNA, 20 bp, Artificial Sequence
  Description of Artificial Sequence: Synthetic oligonucleotide
  Target: FXN; (-) strand; PAM type: YTN; PAM sequence: TTG
ggaaacttgtccacaaaggg

SEQ ID NO: 28851 - DNA, 20 bp, Artificial Sequence
  Description of Artificial Sequence: Synthetic oligonucleotide
  Target: FXN; (-) strand; PAM type: YTN; PAM sequence: TTT
gggaaacttgtccacaaagg

SEQ ID NO: 28852 - DNA, 20 bp, Artificial Sequence
  Description of Artificial Sequence: Synthetic oligonucleotide
  Target: FXN; (-) strand; PAM type: YTN; PAM sequence: TTA
acagatggggaagcagaggt

SEQ ID NO: 28853 - DNA, 20 bp, Artificial Sequence
  Description of Artificial Sequence: Synthetic oligonucleotide
  Target: FXN; (-) strand; PAM type: YTN; PAM sequence: TTT
aacagatggggaagcagagg

SEQ ID NO: 28854 - DNA, 20 bp, Artificial Sequence
  Description of Artificial Sequence: Synthetic oligonucleotide
  Target: FXN; (-) strand; PAM type: YTN; PAM sequence: CTC
atttaacagatggggaagca

SEQ ID NO: 28855 - DNA, 20 bp, Artificial Sequence
  Description of Artificial Sequence: Synthetic oligonucleotide
  Target: FXN; (-) strand; PAM type: YTN; PAM sequence: CTC
tcatttaacagatggggaag

SEQ ID NO: 28856 - DNA, 20 bp, Artificial Sequence
  Description of Artificial Sequence: Synthetic oligonucleotide
  Target: FXN; (-) strand; PAM type: YTN; PAM sequence: TTC
tctcatttaacagatgggga

SEQ ID NO: 28857 - DNA, 20 bp, Artificial Sequence
  Description of Artificial Sequence: Synthetic oligonucleotide
  Target: FXN; (-) strand; PAM type: YTN; PAM sequence: CTA
ttctctcatttaacagatgg

SEQ ID NO: 28858 - DNA, 20 bp, Artificial Sequence
  Description of Artificial Sequence: Synthetic oligonucleotide
  Target: FXN; (-) strand; PAM type: YTN; PAM sequence: CTC
tattctctcatttaacagat

SEQ ID NO: 28859 - DNA, 20 bp, Artificial Sequence
  Description of Artificial Sequence: Synthetic oligonucleotide
  Target: FXN; (-) strand; PAM type: YTN; PAM sequence: CTG
ggaatcaaccatactctatt

SEQ ID NO: 28860 - DNA, 20 bp, Artificial Sequence
  Description of Artificial Sequence: Synthetic oligonucleotide
  Target: FXN; (-) strand; PAM type: YTN; PAM sequence: CTG
aatgctgggaatcaaccata

SEQ ID NO: 28861 - DNA, 20 bp, Artificial Sequence
  Description of Artificial Sequence: Synthetic oligonucleotide
  Target: FXN; (-) strand; PAM type: YTN; PAM sequence: TTG
acaggaccactgaatgctgg

SEQ ID NO: 28862 - DNA, 20 bp, Artificial Sequence
  Description of Artificial Sequence: Synthetic oligonucleotide
  Target: FXN; (-) strand; PAM type: YTN; PAM sequence: CTT
gacaggaccactgaatgctg

SEQ ID NO: 28863 - DNA, 20 bp, Artificial Sequence
  Description of Artificial Sequence: Synthetic oligonucleotide
  Target: FXN; (-) strand; PAM type: YTN; PAM sequence: TTG
cttgacaggaccactgaatg

SEQ ID NO: 28864 - DNA, 20 bp, Artificial Sequence
  Description of Artificial Sequence: Synthetic oligonucleotide
  Target: FXN; (-) strand; PAM type: YTN; PAM sequence: TTA
ggttgcttgacaggaccact

SEQ ID NO: 28865 - DNA, 20 bp, Artificial Sequence
  Description of Artificial Sequence: Synthetic oligonucleotide
  Target: FXN; (-) strand; PAM type: YTN; PAM sequence: CTG
ttaggttgcttgacaggacc

SEQ ID NO: 28866 - DNA, 20 bp, Artificial Sequence
  Description of Artificial Sequence: Synthetic oligonucleotide
  Target: FXN; (-) strand; PAM type: YTN; PAM sequence: CTA
gcctgttaggttgcttgaca

SEQ ID NO: 28867 - DNA, 20 bp, Artificial Sequence
  Description of Artificial Sequence: Synthetic oligonucleotide
  Target: FXN; (-) strand; PAM type: YTN; PAM sequence: TTA
gaactagcctgttaggttgc

SEQ ID NO: 28868 - DNA, 20 bp, Artificial Sequence
  Description of Artificial Sequence: Synthetic oligonucleotide
  Target: FXN; (-) strand; PAM type: YTN; PAM sequence: CTA
cccaatagggaattagaact

SEQ ID NO: 28869 - DNA, 20 bp, Artificial Sequence
  Description of Artificial Sequence: Synthetic oligonucleotide
  Target: FXN; (-) strand; PAM type: YTN; PAM sequence: CTC
atctacccaatagggaatta

SEQ ID NO: 28870 - DNA, 20 bp, Artificial Sequence
  Description of Artificial Sequence: Synthetic oligonucleotide
  Target: FXN; (-) strand; PAM type: YTN; PAM sequence: TTG
tcatcccctcatctacccaa

SEQ ID NO: 28871 - DNA, 20 bp, Artificial Sequence
  Description of Artificial Sequence: Synthetic oligonucleotide
  Target: FXN; (-) strand; PAM type: YTN; PAM sequence: TTT
gtcatcccctcatctaccca

SEQ ID NO: 28872 - DNA, 20 bp, Artificial Sequence
  Description of Artificial Sequence: Synthetic oligonucleotide
  Target: FXN; (-) strand; PAM type: YTN; PAM sequence: CTT
tgtcatcccctcatctaccc

SEQ ID NO: 28873 - DNA, 20 bp, Artificial Sequence
  Description of Artificial Sequence: Synthetic oligonucleotide
  Target: FXN; (-) strand; PAM type: YTN; PAM sequence: TTC
tttgtcatcccctcatctac

SEQ ID NO: 28874 - DNA, 20 bp, Artificial Sequence
  Description of Artificial Sequence: Synthetic oligonucleotide
  Target: FXN; (-) strand; PAM type: YTN; PAM sequence: CTG
ttctttgtcatcccctcatc

SEQ ID NO: 28875 - DNA, 20 bp, Artificial Sequence
  Description of Artificial Sequence: Synthetic oligonucleotide
  Target: FXN; (-) strand; PAM type: YTN; PAM sequence: TTA
aaaactgttctttgtcatcc

SEQ ID NO: 28876 - DNA, 20 bp, Artificial Sequence
  Description of Artificial Sequence: Synthetic oligonucleotide
  Target: FXN; (-) strand; PAM type: YTN; PAM sequence: CTT
aaaaactgttctttgtcatc

SEQ ID NO: 28877 - DNA, 20 bp, Artificial Sequence
  Description of Artificial Sequence: Synthetic oligonucleotide
  Target: FXN; (-) strand; PAM type: YTN; PAM sequence: CTA
tatagcttaaaaactgttct

SEQ ID NO: 28878 - DNA, 20 bp, Artificial Sequence
  Description of Artificial Sequence: Synthetic oligonucleotide
  Target: FXN; (-) strand; PAM type: YTN; PAM sequence: TTC
ctatatagcttaaaaactgt

SEQ ID NO: 28879 - DNA, 20 bp, Artificial Sequence
  Description of Artificial Sequence: Synthetic oligonucleotide
  Target: FXN; (-) strand; PAM type: YTN; PAM sequence: TTT
cctatatagcttaaaaactg

SEQ ID NO: 28880 - DNA, 20 bp, Artificial Sequence
  Description of Artificial Sequence: Synthetic oligonucleotide
  Target: FXN; (-) strand; PAM type: YTN; PAM sequence: CTG
aaatcacgatagggcaacac

SEQ ID NO: 28881 - DNA, 20 bp, Artificial Sequence
  Description of Artificial Sequence: Synthetic oligonucleotide
  Target: FXN; (-) strand; PAM type: YTN; PAM sequence: TTC
aactgaaatcacgatagggc

SEQ ID NO: 28882 - DNA, 20 bp, Artificial Sequence
  Description of Artificial Sequence: Synthetic oligonucleotide
  Target: FXN; (-) strand; PAM type: YTN; PAM sequence: TTC
acatgaattcaactgaaatc

SEQ ID NO: 28883 - DNA, 20 bp, Artificial Sequence
  Description of Artificial Sequence: Synthetic oligonucleotide
  Target: FXN; (-) strand; PAM type: YTN; PAM sequence: TTT
cacatgaattcaactgaaat

SEQ ID NO: 28884 - DNA, 20 bp, Artificial Sequence
  Description of Artificial Sequence: Synthetic oligonucleotide
  Target: FXN; (-) strand; PAM type: YTN; PAM sequence: TTT
tcacatgaattcaactgaaa

SEQ ID NO: 28885 - DNA, 20 bp, Artificial Sequence
  Description of Artificial Sequence: Synthetic oligonucleotide
  Target: FXN; (-) strand; PAM type: YTN; PAM sequence: TTA
ttttcacatgaattcaactg

SEQ ID NO: 28886 - DNA, 20 bp, Artificial Sequence
  Description of Artificial Sequence: Synthetic oligonucleotide
  Target: FXN; (-) strand; PAM type: YTN; PAM sequence: CTA
ttattttcacatgaattcaa

SEQ ID NO: 28887 - DNA, 20 bp, Artificial Sequence
  Description of Artificial Sequence: Synthetic oligonucleotide
  Target: FXN; (-) strand; PAM type: YTN; PAM sequence: TTA
caggtgtgagccaccgcgcc

SEQ ID NO: 28888 - DNA, 20 bp, Artificial Sequence
  Description of Artificial Sequence: Synthetic oligonucleotide
  Target: FXN; (-) strand; PAM type: YTN; PAM sequence: CTG
ggattacaggtgtgagccac

SEQ ID NO: 28889 - DNA, 20 bp, Artificial Sequence
  Description of Artificial Sequence: Synthetic oligonucleotide
  Target: FXN; (-) strand; PAM type: YTN; PAM sequence: CTC
caaaagtgctgggattacag

SEQ ID NO: 28890 - DNA, 20 bp, Artificial Sequence
  Description of Artificial Sequence: Synthetic oligonucleotide
  Target: FXN; (-) strand; PAM type: YTN; PAM sequence: TTG
gcctccaaaagtgctgggat

SEQ ID NO: 28891 - DNA, 20 bp, Artificial Sequence
  Description of Artificial Sequence: Synthetic oligonucleotide
  Target: FXN; (-) strand; PAM type: YTN; PAM sequence: CTT
ggcctccaaaagtgctggga

SEQ ID NO: 28892 - DNA, 20 bp, Artificial Sequence
  Description of Artificial Sequence: Synthetic oligonucleotide
  Target: FXN; (-) strand; PAM type: YTN; PAM sequence: CTC
aggtgatccacccaccttgg

SEQ ID NO: 28893 - DNA, 20 bp, Artificial Sequence
  Description of Artificial Sequence: Synthetic oligonucleotide
  Target: FXN; (-) strand; PAM type: YTN; PAM sequence: CTG
acctcaggtgatccacccac

SEQ ID NO: 28894 - DNA, 20 bp, Artificial Sequence
  Description of Artificial Sequence: Synthetic oligonucleotide
  Target: FXN; (-) strand; PAM type: YTN; PAM sequence: CTC
ctgacctcaggtgatccacc

SEQ ID NO: 28895 - DNA, 20 bp, Artificial Sequence
  Description of Artificial Sequence: Synthetic oligonucleotide
  Target: FXN; (-) strand; PAM type: YTN; PAM sequence: TTG
aactcctgacctcaggtgat

SEQ ID NO: 28896 - DNA, 20 bp, Artificial Sequence
  Description of Artificial Sequence: Synthetic oligonucleotide
  Target: FXN; (-) strand; PAM type: YTN; PAM sequence: CTT
gaactcctgacctcaggtga

SEQ ID NO: 28897 - DNA, 20 bp, Artificial Sequence
  Description of Artificial Sequence: Synthetic oligonucleotide
  Target: FXN; (-) strand; PAM type: YTN; PAM sequence: CTG
gtcttgaactcctgacctca

SEQ ID NO: 28898 - DNA, 20 bp, Artificial Sequence
  Description of Artificial Sequence: Synthetic oligonucleotide
  Target: FXN; (-) strand; PAM type: YTN; PAM sequence: TTG
gccaggctggtcttgaactc

SEQ ID NO: 28899 - DNA, 20 bp, Artificial Sequence
  Description of Artificial Sequence: Synthetic oligonucleotide
  Target: FXN; (-) strand; PAM type: YTN; PAM sequence: TTC
atcatgttggccaggctggt

SEQ ID NO: 28900 - DNA, 20 bp, Artificial Sequence
  Description of Artificial Sequence: Synthetic oligonucleotide
  Target: FXN; (-) strand; PAM type: YTN; PAM sequence: TTT
catcatgttggccaggctgg

SEQ ID NO: 28901 - DNA, 20 bp, Artificial Sequence
  Description of Artificial Sequence: Synthetic oligonucleotide
  Target: FXN; (-) strand; PAM type: YTN; PAM sequence: TTA
gtagagacggggtttcatca

SEQ ID NO: 28902 - DNA, 20 bp, Artificial Sequence
  Description of Artificial Sequence: Synthetic oligonucleotide
  Target: FXN; (-) strand; PAM type: YTN; PAM sequence: TTT
agtagagacggggtttcatc

SEQ ID NO: 28903 - DNA, 20 bp, Artificial Sequence
  Description of Artificial Sequence: Synthetic oligonucleotide
  Target: FXN; (-) strand; PAM type: YTN; PAM sequence: TTT
tagtagagacggggtttcat

SEQ ID NO: 28904 - DNA, 20 bp, Artificial Sequence
  Description of Artificial Sequence: Synthetic oligonucleotide
  Target: FXN; (-) strand; PAM type: YTN; PAM sequence: TTT
ttagtagagacggggtttca

SEQ ID NO: 28905 - DNA, 20 bp, Artificial Sequence
  Description of Artificial Sequence: Synthetic oligonucleotide
  Target: FXN; (-) strand; PAM type: YTN; PAM sequence: TTG
tatttttagtagagacgggg

SEQ ID NO: 28906 - DNA, 20 bp, Artificial Sequence
  Description of Artificial Sequence: Synthetic oligonucleotide
  Target: FXN; (-) strand; PAM type: YTN; PAM sequence: TTT
gtatttttagtagagacggg

SEQ ID NO: 28907 - DNA, 20 bp, Artificial Sequence
  Description of Artificial Sequence: Synthetic oligonucleotide
  Target: FXN; (-) strand; PAM type: YTN; PAM sequence: TTT
tgtatttttagtagagacgg

SEQ ID NO: 28908 - DNA, 20 bp, Artificial Sequence
  Description of Artificial Sequence: Synthetic oligonucleotide
  Target: FXN; (-) strand; PAM type: YTN; PAM sequence: TTT
ttgtatttttagtagagacg

SEQ ID NO: 28909 - DNA, 20 bp, Artificial Sequence
  Description of Artificial Sequence: Synthetic oligonucleotide
  Target: FXN; (-) strand; PAM type: YTN; PAM sequence: TTT
tttgtatttttagtagagac

SEQ ID NO: 28910 - DNA, 20 bp, Artificial Sequence
  Description of Artificial Sequence: Synthetic oligonucleotide
  Target: FXN; (-) strand; PAM type: YTN; PAM sequence: CTA
attttttgtatttttagtag

SEQ ID NO: 28911 - DNA, 20 bp, Artificial Sequence
  Description of Artificial Sequence: Synthetic oligonucleotide
  Target: FXN; (-) strand; PAM type: YTN; PAM sequence: CTG
ccatcatgcccggctaattt

SEQ ID NO: 28912 - DNA, 20 bp, Artificial Sequence
  Description of Artificial Sequence: Synthetic oligonucleotide
  Target: FXN; (-) strand; PAM type: YTN; PAM sequence: TTA
caggcacctgccatcatgcc

SEQ ID NO: 28913 - DNA, 20 bp, Artificial Sequence
  Description of Artificial Sequence: Synthetic oligonucleotide
  Target: FXN; (-) strand; PAM type: YTN; PAM sequence: CTG
ggattacaggcacctgccat

SEQ ID NO: 28914 - DNA, 20 bp, Artificial Sequence
  Description of Artificial Sequence: Synthetic oligonucleotide
  Target: FXN; (-) strand; PAM type: YTN; PAM sequence: CTC
ccaagtagctgggattacag

SEQ ID NO: 28915 - DNA, 20 bp, Artificial Sequence
  Description of Artificial Sequence: Synthetic oligonucleotide
  Target: FXN; (-) strand; PAM type: YTN; PAM sequence: TTC
agcctcccaagtagctggga

SEQ ID NO: 28916 - DNA, 20 bp, Artificial Sequence
  Description of Artificial Sequence: Synthetic oligonucleotide
  Target: FXN; (-) strand; PAM type: YTN; PAM sequence: CTT
cagcctcccaagtagctggg

SEQ ID NO: 28917 - DNA, 20 bp, Artificial Sequence
  Description of Artificial Sequence: Synthetic oligonucleotide
  Target: FXN; (-) strand; PAM type: YTN; PAM sequence: TTC
cgcttcagcctcccaagtag

SEQ ID NO: 28918 - DNA, 20 bp, Artificial Sequence
  Description of Artificial Sequence: Synthetic oligonucleotide
  Target: FXN; (-) strand; PAM type: YTN; PAM sequence: CTT
ccgcttcagcctcccaagta

SEQ ID NO: 28919 - DNA, 20 bp, Artificial Sequence
  Description of Artificial Sequence: Synthetic oligonucleotide
  Target: FXN; (-) strand; PAM type: YTN; PAM sequence: TTC
ttccgcttcagcctcccaag

SEQ ID NO: 28920 - DNA, 20 bp, Artificial Sequence
  Description of Artificial Sequence: Synthetic oligonucleotide
  Target: FXN; (-) strand; PAM type: YTN; PAM sequence: TTC
aagcgattcttccgcttcag

SEQ ID NO: 28921 - DNA, 20 bp, Artificial Sequence
  Description of Artificial Sequence: Synthetic oligonucleotide
  Target: FXN; (-) strand; PAM type: YTN; PAM sequence: CTG
ggttcaagcgattcttccgc

SEQ ID NO: 28922 - DNA, 20 bp, Artificial Sequence
  Description of Artificial Sequence: Synthetic oligonucleotide
  Target: FXN; (-) strand; PAM type: YTN; PAM sequence: CTC
tgggttcaagcgattcttcc

SEQ ID NO: 28923 - DNA, 20 bp, Artificial Sequence
  Description of Artificial Sequence: Synthetic oligonucleotide
  Target: FXN; (-) strand; PAM type: YTN; PAM sequence: CTC
cacctctgggttcaagcgat

SEQ ID NO: 28924 - DNA, 20 bp, Artificial Sequence
  Description of Artificial Sequence: Synthetic oligonucleotide
  Target: FXN; (-) strand; PAM type: YTN; PAM sequence: CTG
caacctccacctctgggttc

SEQ ID NO: 28925 - DNA, 20 bp, Artificial Sequence
  Description of Artificial Sequence: Synthetic oligonucleotide
  Target: FXN; (-) strand; PAM type: YTN; PAM sequence: CTC
actgcaacctccacctctgg

SEQ ID NO: 28926 - DNA, 20 bp, Artificial Sequence
  Description of Artificial Sequence: Synthetic oligonucleotide
  Target: FXN; (-) strand; PAM type: YTN; PAM sequence: CTC
ggctcactgcaacctccacc

SEQ ID NO: 28927 - DNA, 20 bp, Artificial Sequence
  Description of Artificial Sequence: Synthetic oligonucleotide
  Target: FXN; (-) strand; PAM type: YTN; PAM sequence: TTA
cagtgcaatggcacgatctc

SEQ ID NO: 28928 - DNA, 20 bp, Artificial Sequence
  Description of Artificial Sequence: Synthetic oligonucleotide
  Target: FXN; (-) strand; PAM type: YTN; PAM sequence: CTC
agtcacccaggttacagtgc

SEQ ID NO: 28929 - DNA, 20 bp, Artificial Sequence
  Description of Artificial Sequence: Synthetic oligonucleotide
  Target: FXN; (-) strand; PAM type: YTN; PAM sequence: TTG
ctcagtcacccaggttacag

SEQ ID NO: 28930 - DNA, 20 bp, Artificial Sequence
  Description of Artificial Sequence: Synthetic oligonucleotide
  Target: FXN; (-) strand; PAM type: YTN; PAM sequence: TTT
gctcagtcacccaggttaca

SEQ ID NO: 28931 - DNA, 20 bp, Artificial Sequence
  Description of Artificial Sequence: Synthetic oligonucleotide
  Target: FXN; (-) strand; PAM type: YTN; PAM sequence: TTT
tgctcagtcacccaggttac

SEQ ID NO: 28932 - DNA, 20 bp, Artificial Sequence
  Description of Artificial Sequence: Synthetic oligonucleotide
  Target: FXN; (-) strand; PAM type: YTN; PAM sequence: TTG
agacagagttttgctcagtc

SEQ ID NO: 28933 - DNA, 20 bp, Artificial Sequence
  Description of Artificial Sequence: Synthetic oligonucleotide
  Target: FXN; (-) strand; PAM type: YTN; PAM sequence: TTT
gagacagagttttgctcagt

SEQ ID NO: 28934 - DNA, 20 bp, Artificial Sequence
  Description of Artificial Sequence: Synthetic oligonucleotide
  Target: FXN; (-) strand; PAM type: YTN; PAM sequence: TTT
tgagacagagttttgctcag

SEQ ID NO: 28935 - DNA, 20 bp, Artificial Sequence
  Description of Artificial Sequence: Synthetic oligonucleotide
  Target: FXN; (-) strand; PAM type: YTN; PAM sequence: TTA
ttttgagacagagttttgct

SEQ ID NO: 28936 - DNA, 20 bp, Artificial Sequence
  Description of Artificial Sequence: Synthetic oligonucleotide
  Target: FXN; (-) strand; PAM type: YTN; PAM sequence: TTA
ttattttgagacagagtttt

SEQ ID NO: 28937 - DNA, 20 bp, Artificial Sequence
  Description of Artificial Sequence: Synthetic oligonucleotide
  Target: FXN; (-) strand; PAM type: YTN; PAM sequence: TTA
ttattattttgagacagagt

SEQ ID NO: 28938 - DNA, 20 bp, Artificial Sequence
  Description of Artificial Sequence: Synthetic oligonucleotide
  Target: FXN; (-) strand; PAM type: YTN; PAM sequence: TTG
ttattattattttgagacag

SEQ ID NO: 28939 - DNA, 20 bp, Artificial Sequence
  Description of Artificial Sequence: Synthetic oligonucleotide
  Target: FXN; (-) strand; PAM type: YTN; PAM sequence: TTA
tattgttattattattttga

SEQ ID NO: 28940 - DNA, 20 bp, Artificial Sequence
  Description of Artificial Sequence: Synthetic oligonucleotide
  Target: FXN; (-) strand; PAM type: YTN; PAM sequence: TTA
ttatattgttattattattt

SEQ ID NO: 28941 - DNA, 20 bp, Artificial Sequence
  Description of Artificial Sequence: Synthetic oligonucleotide
  Target: FXN; (-) strand; PAM type: YTN; PAM sequence: TTA
ttattatattgttattatta

SEQ ID NO: 28942 - DNA, 20 bp, Artificial Sequence
  Description of Artificial Sequence: Synthetic oligonucleotide
  Target: FXN; (-) strand; PAM type: YTN; PAM sequence: TTA
ttattattatattgttatta

SEQ ID NO: 28943 - DNA, 20 bp, Artificial Sequence
  Description of Artificial Sequence: Synthetic oligonucleotide
  Target: FXN; (-) strand; PAM type: YTN; PAM sequence: CTA
ttattattattatattgtta

SEQ ID NO: 28944 - DNA, 20 bp, Artificial Sequence
  Description of Artificial Sequence: Synthetic oligonucleotide
  Target: FXN; (-) strand; PAM type: YTN; PAM sequence: TTA
acccagtaagggtacaataa

SEQ ID NO: 28945 - DNA, 20 bp, Artificial Sequence
  Description of Artificial Sequence: Synthetic oligonucleotide
  Target: FXN; (-) strand; PAM type: YTN; PAM sequence: TTA
aaatgaggtaatgtggtata

SEQ ID NO: 28946 - DNA, 20 bp, Artificial Sequence
  Description of Artificial Sequence: Synthetic oligonucleotide
  Target: FXN; (-) strand; PAM type: YTN; PAM sequence: TTG
tataaagtgcaggtcagtaa

SEQ ID NO: 28947 - DNA, 20 bp, Artificial Sequence
  Description of Artificial Sequence: Synthetic oligonucleotide
  Target: FXN; (-) strand; PAM type: YTN; PAM sequence: TTT
gtataaagtgcaggtcagta

SEQ ID NO: 28948 - DNA, 20 bp, Artificial Sequence
  Description of Artificial Sequence: Synthetic oligonucleotide
  Target: FXN; (-) strand; PAM type: YTN; PAM sequence: CTT
tgtataaagtgcaggtcagt

SEQ ID NO: 28949 - DNA, 20 bp, Artificial Sequence
  Description of Artificial Sequence: Synthetic oligonucleotide
  Target: FXN; (-) strand; PAM type: YTN; PAM sequence: TTG
ctttgtataaagtgcaggtc

SEQ ID NO: 28950 - DNA, 20 bp, Artificial Sequence
  Description of Artificial Sequence: Synthetic oligonucleotide
  Target: FXN; (-) strand; PAM type: YTN; PAM sequence: TTG
ttgctttgtataaagtgcag

SEQ ID NO: 28951 - DNA, 20 bp, Artificial Sequence
  Description of Artificial Sequence: Synthetic oligonucleotide
  Target: FXN; (-) strand; PAM type: YTN; PAM sequence: CTT
gttgctttgtataaagtgca

SEQ ID NO: 28952 - DNA, 20 bp, Artificial Sequence
  Description of Artificial Sequence: Synthetic oligonucleotide
  Target: FXN; (-) strand; PAM type: YTN; PAM sequence: CTG
gaggcttgttgctttgtata

SEQ ID NO: 28953 - DNA, 20 bp, Artificial Sequence
  Description of Artificial Sequence: Synthetic oligonucleotide
  Target: FXN; (-) strand; PAM type: YTN; PAM sequence: TTA
atgtcctggaggcttgttgc

SEQ ID NO: 28954 - DNA, 20 bp, Artificial Sequence
  Description of Artificial Sequence: Synthetic oligonucleotide
  Target: FXN; (-) strand; PAM type: YTN; PAM sequence: TTT
aatgtcctggaggcttgttg

SEQ ID NO: 28955 - DNA, 20 bp, Artificial Sequence
  Description of Artificial Sequence: Synthetic oligonucleotide
  Target: FXN; (-) strand; PAM type: YTN; PAM sequence: TTT
taatgtcctggaggcttgtt

SEQ ID NO: 28956 - DNA, 20 bp, Artificial Sequence
  Description of Artificial Sequence: Synthetic oligonucleotide
  Target: FXN; (-) strand; PAM type: YTN; PAM sequence: TTG
catgaattttaatgtcctgg

SEQ ID NO: 28957 - DNA, 20 bp, Artificial Sequence
  Description of Artificial Sequence: Synthetic oligonucleotide
  Target: FXN; (-) strand; PAM type: YTN; PAM sequence: TTT
gcatgaattttaatgtcctg

SEQ ID NO: 28958 - DNA, 20 bp, Artificial Sequence
  Description of Artificial Sequence: Synthetic oligonucleotide
  Target: FXN; (-) strand; PAM type: YTN; PAM sequence: CTT
tgcatgaattttaatgtcct

SEQ ID NO: 28959 - DNA, 20 bp, Artificial Sequence
  Description of Artificial Sequence: Synthetic oligonucleotide
  Target: FXN; (-) strand; PAM type: YTN; PAM sequence: TTA
agtaagaaaataatataaca

SEQ ID NO: 28960 - DNA, 20 bp, Artificial Sequence
  Description of Artificial Sequence: Synthetic oligonucleotide
  Target: FXN; (-) strand; PAM type: YTN; PAM sequence: TTT
aagtaagaaaataatataac

SEQ ID NO: 28961 - DNA, 20 bp, Artificial Sequence
  Description of Artificial Sequence: Synthetic oligonucleotide
  Target: FXN; (-) strand; PAM type: YTN; PAM sequence: CTT
taagtaagaaaataatataa

SEQ ID NO: 28962 - DNA, 20 bp, Artificial Sequence
  Description of Artificial Sequence: Synthetic oligonucleotide
  Target: FXN; (-) strand; PAM type: YTN; PAM sequence: TTC
tttaagtaagaaaataatat

SEQ ID NO: 28963 - DNA, 20 bp, Artificial Sequence
  Description of Artificial Sequence: Synthetic oligonucleotide
  Target: FXN; (-) strand; PAM type: YTN; PAM sequence: CTT
ctttaagtaagaaaataata

SEQ ID NO: 28964 - DNA, 20 bp, Artificial Sequence
  Description of Artificial Sequence: Synthetic oligonucleotide
  Target: FXN; (-) strand; PAM type: YTN; PAM sequence: CTA
ataaatccttctttaagtaa

SEQ ID NO: 28965 - DNA, 20 bp, Artificial Sequence
  Description of Artificial Sequence: Synthetic oligonucleotide
  Target: FXN; (-) strand; PAM type: YTN; PAM sequence: TTA
caggtgcacgccaccatgcc

SEQ ID NO: 28966 - DNA, 20 bp, Artificial Sequence
  Description of Artificial Sequence: Synthetic oligonucleotide
  Target: FXN; (-) strand; PAM type: YTN; PAM sequence: CTG
ggattacaggtgcacgccac

SEQ ID NO: 28967 - DNA, 20 bp, Artificial Sequence
  Description of Artificial Sequence: Synthetic oligonucleotide
  Target: FXN; (-) strand; PAM type: YTN; PAM sequence: CTG
agtacctgggattacaggtg

SEQ ID NO: 28968 - DNA, 20 bp, Artificial Sequence
  Description of Artificial Sequence: Synthetic oligonucleotide
  Target: FXN; (-) strand; PAM type: YTN; PAM sequence: CTC
ctgagtacctgggattacag

SEQ ID NO: 28969 - DNA, 20 bp, Artificial Sequence
  Description of Artificial Sequence: Synthetic oligonucleotide
  Target: FXN; (-) strand; PAM type: YTN; PAM sequence: CTC
agcctcctgagtacctggga

SEQ ID NO: 28970 - DNA, 20 bp, Artificial Sequence
  Description of Artificial Sequence: Synthetic oligonucleotide
  Target: FXN; (-) strand; PAM type: YTN; PAM sequence: CTC
ccgtctcagcctcctgagta

SEQ ID NO: 28971 - DNA, 20 bp, Artificial Sequence
  Description of Artificial Sequence: Synthetic oligonucleotide
  Target: FXN; (-) strand; PAM type: YTN; PAM sequence: TTC
tcccgtctcagcctcctgag

SEQ ID NO: 28972 - DNA, 20 bp, Artificial Sequence
  Description of Artificial Sequence: Synthetic oligonucleotide
  Target: FXN; (-) strand; PAM type: YTN; PAM sequence: CTG
gggtcaagcaattctcccgt

SEQ ID NO: 28973 - DNA, 20 bp, Artificial Sequence
  Description of Artificial Sequence: Synthetic oligonucleotide
  Target: FXN; (-) strand; PAM type: YTN; PAM sequence: CTC
cgcctggggtcaagcaattc

SEQ ID NO: 28974 - DNA, 20 bp, Artificial Sequence
  Description of Artificial Sequence: Synthetic oligonucleotide
  Target: FXN; (-) strand; PAM type: YTN; PAM sequence: CTC
ctccgcctggggtcaagcaa

SEQ ID NO: 28975 - DNA, 20 bp, Artificial Sequence
  Description of Artificial Sequence: Synthetic oligonucleotide
  Target: FXN; (-) strand; PAM type: YTN; PAM sequence: CTG
taacctcctccgcctggggt

SEQ ID NO: 28976 - DNA, 20 bp, Artificial Sequence
  Description of Artificial Sequence: Synthetic oligonucleotide
  Target: FXN; (-) strand; PAM type: YTN; PAM sequence: CTC
actgtaacctcctccgcctg

SEQ ID NO: 28977 - DNA, 20 bp, Artificial Sequence
  Description of Artificial Sequence: Synthetic oligonucleotide
  Target: FXN; (-) strand; PAM type: YTN; PAM sequence: CTC
gactcactgtaacctcctcc

SEQ ID NO: 28978 - DNA, 20 bp, Artificial Sequence
  Description of Artificial Sequence: Synthetic oligonucleotide
  Target: FXN; (-) strand; PAM type: YTN; PAM sequence: CTC
aggtacgatctcgactcact

SEQ ID NO: 28979 - DNA, 20 bp, Artificial Sequence
  Description of Artificial Sequence: Synthetic oligonucleotide
  Target: FXN; (-) strand; PAM type: YTN; PAM sequence: CTG
tcgctcaggtacgatctcga

SEQ ID NO: 28980 - DNA, 20 bp, Artificial Sequence
  Description of Artificial Sequence: Synthetic oligonucleotide
  Target: FXN; (-) strand; PAM type: YTN; PAM sequence: CTC
tgtcgctcaggtacgatctc

SEQ ID NO: 28981 - DNA, 20 bp, Artificial Sequence
  Description of Artificial Sequence: Synthetic oligonucleotide
  Target: FXN; (-) strand; PAM type: YTN; PAM sequence: CTC
gctctgtcgctcaggtacga

SEQ ID NO: 28982 - DNA, 20 bp, Artificial Sequence
  Description of Artificial Sequence: Synthetic oligonucleotide
  Target: FXN; (-) strand; PAM type: YTN; PAM sequence: TTG
agacggagtctcgctctgtc

SEQ ID NO: 28983 - DNA, 20 bp, Artificial Sequence
  Description of Artificial Sequence: Synthetic oligonucleotide
  Target: FXN; (-) strand; PAM type: YTN; PAM sequence: TTT
gagacggagtctcgctctgt

SEQ ID NO: 28984 - DNA, 20 bp, Artificial Sequence
  Description of Artificial Sequence: Synthetic oligonucleotide
  Target: FXN; (-) strand; PAM type: YTN; PAM sequence: TTT
tgagacggagtctcgctctg

SEQ ID NO: 28985 - DNA, 20 bp, Artificial Sequence
  Description of Artificial Sequence: Synthetic oligonucleotide
  Target: FXN; (-) strand; PAM type: YTN; PAM sequence: TTT
ttgagacggagtctcgctct

SEQ ID NO: 28986 - DNA, 20 bp, Artificial Sequence
  Description of Artificial Sequence: Synthetic oligonucleotide
  Target: FXN; (-) strand; PAM type: YTN; PAM sequence: TTT
tttgagacggagtctcgctc

SEQ ID NO: 28987 - DNA, 20 bp, Artificial Sequence
  Description of Artificial Sequence: Synthetic oligonucleotide
  Target: FXN; (-) strand; PAM type: YTN; PAM sequence: TTT
ttttgagacggagtctcgct

SEQ ID NO: 28988 - DNA, 20 bp, Artificial Sequence
  Description of Artificial Sequence: Synthetic oligonucleotide
  Target: FXN; (-) strand; PAM type: YTN; PAM sequence: TTT
tttttgagacggagtctcgc

SEQ ID NO: 28989 - DNA, 20 bp, Artificial Sequence
  Description of Artificial Sequence: Synthetic oligonucleotide
  Target: FXN; (-) strand; PAM type: YTN; PAM sequence: TTT
ttttttgagacggagtctcg

SEQ ID NO: 28990 - DNA, 20 bp, Artificial Sequence
  Description of Artificial Sequence: Synthetic oligonucleotide
  Target: FXN; (-) strand; PAM type: YTN; PAM sequence: TTT
tttttttgagacggagtctc

SEQ ID NO: 28991 - DNA, 20 bp, Artificial Sequence
  Description of Artificial Sequence: Synthetic oligonucleotide
  Target: FXN; (-) strand; PAM type: YTN; PAM sequence: TTT
ttttttttgagacggagtct

SEQ ID NO: 28992 - DNA, 20 bp, Artificial Sequence
  Description of Artificial Sequence: Synthetic oligonucleotide
  Target: FXN; (-) strand; PAM type: YTN; PAM sequence: TTT
tttttttttgagacggagtc

SEQ ID NO: 28993 - DNA, 20 bp, Artificial Sequence
  Description of Artificial Sequence: Synthetic oligonucleotide
  Target: FXN; (-) strand; PAM type: YTN; PAM sequence: TTT
ttttttttttgagacggagt

SEQ ID NO: 28994 - DNA, 20 bp, Artificial Sequence
  Description of Artificial Sequence: Synthetic oligonucleotide
  Target: FXN; (-) strand; PAM type: YTN; PAM sequence: TTT
tttttttttttgagacggag

SEQ ID NO: 28995 - DNA, 20 bp, Artificial Sequence
  Description of Artificial Sequence: Synthetic oligonucleotide
  Target: FXN; (-) strand; PAM type: YTN; PAM sequence: CTT
ttttttttttttgagacgga

SEQ ID NO: 28996 - DNA, 20 bp, Artificial Sequence
  Description of Artificial Sequence: Synthetic oligonucleotide
  Target: FXN; (-) strand; PAM type: YTN; PAM sequence: CTC
cttttttttttttttgagac

SEQ ID NO: 28997 - DNA, 20 bp, Artificial Sequence
  Description of Artificial Sequence: Synthetic oligonucleotide
  Target: FXN; (-) strand; PAM type: YTN; PAM sequence: TTA
ataaaccctccttttttttt

SEQ ID NO: 28998 - DNA, 20 bp, Artificial Sequence
  Description of Artificial Sequence: Synthetic oligonucleotide
  Target: FXN; (-) strand; PAM type: YTN; PAM sequence: CTC
attaataaaccctccttttt

SEQ ID NO: 28999 - DNA, 20 bp, Artificial Sequence
  Description of Artificial Sequence: Synthetic oligonucleotide
  Target: FXN; (-) strand; PAM type: YTN; PAM sequence: TTC
tcattaataaaccctccttt

SEQ ID NO: 29000 - DNA, 20 bp, Artificial Sequence
  Description of Artificial Sequence: Synthetic oligonucleotide
  Target: FXN; (-) strand; PAM type: YTN; PAM sequence: CTT
ctcattaataaaccctcctt

SEQ ID NO: 29001 - DNA, 20 bp, Artificial Sequence
  Description of Artificial Sequence: Synthetic oligonucleotide
  Target: FXN; (-) strand; PAM type: YTN; PAM sequence: TTA
atacaaacttctcattaata

SEQ ID NO: 29002 - DNA, 20 bp, Artificial Sequence
  Description of Artificial Sequence: Synthetic oligonucleotide
  Target: FXN; (-) strand; PAM type: YTN; PAM sequence: CTA
catattaatacaaacttctc

SEQ ID NO: 29003 - DNA, 20 bp, Artificial Sequence
  Description of Artificial Sequence: Synthetic oligonucleotide
  Target: FXN; (-) strand; PAM type: YTN; PAM sequence: TTG
ctacatattaatacaaactt

SEQ ID NO: 29004 - DNA, 20 bp, Artificial Sequence
  Description of Artificial Sequence: Synthetic oligonucleotide
  Target: FXN; (-) strand; PAM type: YTN; PAM sequence: TTT
gctacatattaatacaaact

SEQ ID NO: 29005 - DNA, 20 bp, Artificial Sequence
  Description of Artificial Sequence: Synthetic oligonucleotide
  Target: FXN; (-) strand; PAM type: YTN; PAM sequence: CTT
tgctacatattaatacaaac

SEQ ID NO: 29006 - DNA, 20 bp, Artificial Sequence
  Description of Artificial Sequence: Synthetic oligonucleotide
  Target: FXN; (-) strand; PAM type: YTN; PAM sequence: TTG
gaaaagcctttgctacatat

SEQ ID NO: 29007 - DNA, 20 bp, Artificial Sequence
  Description of Artificial Sequence: Synthetic oligonucleotide
  Target: FXN; (-) strand; PAM type: YTN; PAM sequence: TTC
acccattggaaaagcctttg

SEQ ID NO: 29008 - DNA, 20 bp, Artificial Sequence
  Description of Artificial Sequence: Synthetic oligonucleotide
  Target: FXN; (-) strand; PAM type: YTN; PAM sequence: TTA
ttcacccattggaaaagcct

SEQ ID NO: 29009 - DNA, 20 bp, Artificial Sequence
  Description of Artificial Sequence: Synthetic oligonucleotide
  Target: FXN; (-) strand; PAM type: YTN; PAM sequence: TTT
attcacccattggaaaagcc

SEQ ID NO: 29010 - DNA, 20 bp, Artificial Sequence
  Description of Artificial Sequence: Synthetic oligonucleotide
  Target: FXN; (-) strand; PAM type: YTN; PAM sequence: TTT
tattcacccattggaaaagc

SEQ ID NO: 29011 - DNA, 20 bp, Artificial Sequence
  Description of Artificial Sequence: Synthetic oligonucleotide
  Target: FXN; (-) strand; PAM type: YTN; PAM sequence: TTT
ttattcacccattggaaaag

SEQ ID NO: 29012 - DNA, 20 bp, Artificial Sequence
  Description of Artificial Sequence: Synthetic oligonucleotide
  Target: FXN; (-) strand; PAM type: YTN; PAM sequence: TTA
atggaatgtgtttttattca

SEQ ID NO: 29013 - DNA, 20 bp, Artificial Sequence
  Description of Artificial Sequence: Synthetic oligonucleotide
  Target: FXN; (-) strand; PAM type: YTN; PAM sequence: CTT
aatggaatgtgtttttattc

SEQ ID NO: 29014 - DNA, 20 bp, Artificial Sequence
  Description of Artificial Sequence: Synthetic oligonucleotide
  Target: FXN; (-) strand; PAM type: YTN; PAM sequence: TTG
acttaatggaatgtgttttt

SEQ ID NO: 29015 - DNA, 20 bp, Artificial Sequence
  Description of Artificial Sequence: Synthetic oligonucleotide
  Target: FXN; (-) strand; PAM type: YTN; PAM sequence: CTT
gacttaatggaatgtgtttt

SEQ ID NO: 29016 - DNA, 20 bp, Artificial Sequence
  Description of Artificial Sequence: Synthetic oligonucleotide
  Target: FXN; (-) strand; PAM type: YTN; PAM sequence: CTC
ccagcttgacttaatggaat

SEQ ID NO: 29017 - DNA, 20 bp, Artificial Sequence
  Description of Artificial Sequence: Synthetic oligonucleotide
  Target: FXN; (-) strand; PAM type: YTN; PAM sequence: CTG
ctcccagcttgacttaatgg

SEQ ID NO: 29018 - DNA, 20 bp, Artificial Sequence
  Description of Artificial Sequence: Synthetic oligonucleotide
  Target: FXN; (-) strand; PAM type: YTN; PAM sequence: CTA
taggtatatgccactgctcc

SEQ ID NO: 29019 - DNA, 20 bp, Artificial Sequence
  Description of Artificial Sequence: Synthetic oligonucleotide
  Target: FXN; (-) strand; PAM type: YTN; PAM sequence: CTG
ggactataggtatatgccac

SEQ ID NO: 29020 - DNA, 20 bp, Artificial Sequence
  Description of Artificial Sequence: Synthetic oligonucleotide
  Target: FXN; (-) strand; PAM type: YTN; PAM sequence: CTG
tgcagctgggactataggta

SEQ ID NO: 29021 - DNA, 20 bp, Artificial Sequence
  Description of Artificial Sequence: Synthetic oligonucleotide
  Target: FXN; (-) strand; PAM type: YTN; PAM sequence: CTC
ctgtgcagctgggactatag

SEQ ID NO: 29022 - DNA, 20 bp, Artificial Sequence
  Description of Artificial Sequence: Synthetic oligonucleotide
  Target: FXN; (-) strand; PAM type: YTN; PAM sequence: CTC
agcctcctgtgcagctggga

SEQ ID NO: 29023 - DNA, 20 bp, Artificial Sequence
  Description of Artificial Sequence: Synthetic oligonucleotide
  Target: FXN; (-) strand; PAM type: YTN; PAM sequence: CTG
tctcagcctcctgtgcagct

SEQ ID NO: 29024 - DNA, 20 bp, Artificial Sequence
  Description of Artificial Sequence: Synthetic oligonucleotide
  Target: FXN; (-) strand; PAM type: YTN; PAM sequence: CTC
ctgtctcagcctcctgtgca

SEQ ID NO: 29025 - DNA, 20 bp, Artificial Sequence
  Description of Artificial Sequence: Synthetic oligonucleotide
  Target: FXN; (-) strand; PAM type: YTN; PAM sequence: TTC
aagcaatcctcctgtctcag

SEQ ID NO: 29026 - DNA, 20 bp, Artificial Sequence
  Description of Artificial Sequence: Synthetic oligonucleotide
  Target: FXN; (-) strand; PAM type: YTN; PAM sequence: CTT
caagcaatcctcctgtctca

SEQ ID NO: 29027 - DNA, 20 bp, Artificial Sequence
  Description of Artificial Sequence: Synthetic oligonucleotide
  Target: FXN; (-) strand; PAM type: YTN; PAM sequence: CTG
gcttcaagcaatcctcctgt

SEQ ID NO: 29028 - DNA, 20 bp, Artificial Sequence
  Description of Artificial Sequence: Synthetic oligonucleotide
  Target: FXN; (-) strand; PAM type: YTN; PAM sequence: TTC
ctggcttcaagcaatcctcc

SEQ ID NO: 29029 - DNA, 20 bp, Artificial Sequence
  Description of Artificial Sequence: Synthetic oligonucleotide
  Target: FXN; (-) strand; PAM type: YTN; PAM sequence: CTC
caattcctggcttcaagcaa

SEQ ID NO: 29030 - DNA, 20 bp, Artificial Sequence
  Description of Artificial Sequence: Synthetic oligonucleotide
  Target: FXN; (-) strand; PAM type: YTN; PAM sequence: CTG
atctccaattcctggcttca

SEQ ID NO: 29031 - DNA, 20 bp, Artificial Sequence
  Description of Artificial Sequence: Synthetic oligonucleotide
  Target: FXN; (-) strand; PAM type: YTN; PAM sequence: TTG
cccaggctgatctccaattc

SEQ ID NO: 29032 - DNA, 20 bp, Artificial Sequence
  Description of Artificial Sequence: Synthetic oligonucleotide
  Target: FXN; (-) strand; PAM type: YTN; PAM sequence: CTG
tgttgcccaggctgatctcc

SEQ ID NO: 29033 - DNA, 20 bp, Artificial Sequence
  Description of Artificial Sequence: Synthetic oligonucleotide
  Target: FXN; (-) strand; PAM type: YTN; PAM sequence: TTG
ctgtgttgcccaggctgatc

SEQ ID NO: 29034 - DNA, 20 bp, Artificial Sequence
  Description of Artificial Sequence: Synthetic oligonucleotide
  Target: FXN; (-) strand; PAM type: YTN; PAM sequence: CTT
gctgtgttgcccaggctgat

SEQ ID NO: 29035 - DNA, 20 bp, Artificial Sequence
  Description of Artificial Sequence: Synthetic oligonucleotide
  Target: FXN; (-) strand; PAM type: YTN; PAM sequence: TTA
agagataggatcttgctgtg

SEQ ID NO: 29036 - DNA, 20 bp, Artificial Sequence
  Description of Artificial Sequence: Synthetic oligonucleotide
  Target: FXN; (-) strand; PAM type: YTN; PAM sequence: TTT
aagagataggatcttgctgt

SEQ ID NO: 29037 - DNA, 20 bp, Artificial Sequence
  Description of Artificial Sequence: Synthetic oligonucleotide
  Target: FXN; (-) strand; PAM type: YTN; PAM sequence: TTT
taagagataggatcttgctg

SEQ ID NO: 29038 - DNA, 20 bp, Artificial Sequence
  Description of Artificial Sequence: Synthetic oligonucleotide
  Target: FXN; (-) strand; PAM type: YTN; PAM sequence: TTT
ttaagagataggatcttgct

SEQ ID NO: 29039 - DNA, 20 bp, Artificial Sequence
  Description of Artificial Sequence: Synthetic oligonucleotide
  Target: FXN; (-) strand; PAM type: YTN; PAM sequence: TTT
tttaagagataggatcttgc

SEQ ID NO: 29040 - DNA, 20 bp, Artificial Sequence
  Description of Artificial Sequence: Synthetic oligonucleotide
  Target: FXN; (-) strand; PAM type: YTN; PAM sequence: TTT
ttttaagagataggatcttg

SEQ ID NO: 29041 - DNA, 20 bp, Artificial Sequence
  Description of Artificial Sequence: Synthetic oligonucleotide
  Target: FXN; (-) strand; PAM type: YTN; PAM sequence: CTT
tttttaagagataggatctt

SEQ ID NO: 29042 - DNA, 20 bp, Artificial Sequence
  Description of Artificial Sequence: Synthetic oligonucleotide
  Target: FXN; (-) strand; PAM type: YTN; PAM sequence: TTC
tttttttaagagataggatc

SEQ ID NO: 29043 - DNA, 20 bp, Artificial Sequence
  Description of Artificial Sequence: Synthetic oligonucleotide
  Target: FXN; (-) strand; PAM type: YTN; PAM sequence: TTT
ctttttttaagagataggat

SEQ ID NO: 29044 - DNA, 20 bp, Artificial Sequence
  Description of Artificial Sequence: Synthetic oligonucleotide
  Target: FXN; (-) strand; PAM type: YTN; PAM sequence: TTT
tctttttttaagagatagga

SEQ ID NO: 29045 - DNA, 20 bp, Artificial Sequence
  Description of Artificial Sequence: Synthetic oligonucleotide
  Target: FXN; (-) strand; PAM type: YTN; PAM sequence: TTT
ttctttttttaagagatagg

SEQ ID NO: 29046 - DNA, 20 bp, Artificial Sequence
  Description of Artificial Sequence: Synthetic oligonucleotide
  Target: FXN; (-) strand; PAM type: YTN; PAM sequence: TTT
tttctttttttaagagatag

SEQ ID NO: 29047 - DNA, 20 bp, Artificial Sequence
  Description of Artificial Sequence: Synthetic oligonucleotide
  Target: FXN; (-) strand; PAM type: YTN; PAM sequence: TTT
ttttctttttttaagagata

SEQ ID NO: 29048 - DNA, 20 bp, Artificial Sequence
  Description of Artificial Sequence: Synthetic oligonucleotide
  Target: FXN; (-) strand; PAM type: YTN; PAM sequence: TTT
tttttctttttttaagagat

SEQ ID NO: 29049 - DNA, 20 bp, Artificial Sequence
  Description of Artificial Sequence: Synthetic oligonucleotide
  Target: FXN; (-) strand; PAM type: YTN; PAM sequence: TTT
ttttttctttttttaagaga

SEQ ID NO: 29050 - DNA, 20 bp, Artificial Sequence
  Description of Artificial Sequence: Synthetic oligonucleotide
  Target: FXN; (-) strand; PAM type: YTN; PAM sequence: TTA
ataggtttttttttcttttt

SEQ ID NO: 29051 - DNA, 20 bp, Artificial Sequence
  Description of Artificial Sequence: Synthetic oligonucleotide
  Target: FXN; (-) strand; PAM type: YTN; PAM sequence: TTA
ttaataggtttttttttctt

SEQ ID NO: 29052 - DNA, 20 bp, Artificial Sequence
  Description of Artificial Sequence: Synthetic oligonucleotide
  Target: FXN; (-) strand; PAM type: YTN; PAM sequence: TTA
ttattaataggttttttttt

SEQ ID NO: 29053 - DNA, 20 bp, Artificial Sequence
  Description of Artificial Sequence: Synthetic oligonucleotide
  Target: FXN; (-) strand; PAM type: YTN; PAM sequence: TTT
attattaataggtttttttt

SEQ ID NO: 29054 - DNA, 20 bp, Artificial Sequence
  Description of Artificial Sequence: Synthetic oligonucleotide
  Target: FXN; (-) strand; PAM type: YTN; PAM sequence: TTT
tattattaataggttttttt

SEQ ID NO: 29055 - DNA, 20 bp, Artificial Sequence
  Description of Artificial Sequence: Synthetic oligonucleotide
  Target: FXN; (-) strand; PAM type: YTN; PAM sequence: CTG
ttttattattaataggtttt

SEQ ID NO: 29056 - DNA, 20 bp, Artificial Sequence
  Description of Artificial Sequence: Synthetic oligonucleotide
  Target: FXN; (-) strand; PAM type: YTN; PAM sequence: TTA
tactgttttattattaatag

SEQ ID NO: 29057 - DNA, 20 bp, Artificial Sequence
  Description of Artificial Sequence: Synthetic oligonucleotide
  Target: FXN; (-) strand; PAM type: YTN; PAM sequence: TTT
atactgttttattattaata

SEQ ID NO: 29058 - DNA, 20 bp, Artificial Sequence
  Description of Artificial Sequence: Synthetic oligonucleotide
  Target: FXN; (-) strand; PAM type: YTN; PAM sequence: TTG
tttatactgttttattatta

SEQ ID NO: 29059 - DNA, 20 bp, Artificial Sequence
  Description of Artificial Sequence: Synthetic oligonucleotide
  Target: FXN; (-) strand; PAM type: YTN; PAM sequence: TTT
gtttatactgttttattatt

SEQ ID NO: 29060 - DNA, 20 bp, Artificial Sequence
  Description of Artificial Sequence: Synthetic oligonucleotide
  Target: FXN; (-) strand; PAM type: YTN; PAM sequence: TTT
tgtttatactgttttattat

SEQ ID NO: 29061 - DNA, 20 bp, Artificial Sequence
  Description of Artificial Sequence: Synthetic oligonucleotide
  Target: FXN; (-) strand; PAM type: YTN; PAM sequence: CTT
ttgtttatactgttttatta

SEQ ID NO: 29062 - DNA, 20 bp, Artificial Sequence
  Description of Artificial Sequence: Synthetic oligonucleotide
  Target: FXN; (-) strand; PAM type: YTN; PAM sequence: TTA
gcttttgtttatactgtttt

SEQ ID NO: 29063 - DNA, 20 bp, Artificial Sequence
  Description of Artificial Sequence: Synthetic oligonucleotide
  Target: FXN; (-) strand; PAM type: YTN; PAM sequence: TTT
agcttttgtttatactgttt

SEQ ID NO: 29064 - DNA, 20 bp, Artificial Sequence
  Description of Artificial Sequence: Synthetic oligonucleotide
  Target: FXN; (-) strand; PAM type: YTN; PAM sequence: CTA
tttagcttttgtttatactg

SEQ ID NO: 29065 - DNA, 20 bp, Artificial Sequence
  Description of Artificial Sequence: Synthetic oligonucleotide
  Target: FXN; (-) strand; PAM type: YTN; PAM sequence: TTA
cctatttagcttttgtttat

SEQ ID NO: 29066 - DNA, 20 bp, Artificial Sequence
  Description of Artificial Sequence: Synthetic oligonucleotide
  Target: FXN; (-) strand; PAM type: YTN; PAM sequence: TTT
acctatttagcttttgttta

SEQ ID NO: 29067 - DNA, 20 bp, Artificial Sequence
  Description of Artificial Sequence: Synthetic oligonucleotide
  Target: FXN; (-) strand; PAM type: YTN; PAM sequence: TTT
tacctatttagcttttgttt

SEQ ID NO: 29068 - DNA, 20 bp, Artificial Sequence
  Description of Artificial Sequence: Synthetic oligonucleotide
  Target: FXN; (-) strand; PAM type: YTN; PAM sequence: TTC
agaaaaaatattttacctat

SEQ ID NO: 29069 - DNA, 20 bp, Artificial Sequence
  Description of Artificial Sequence: Synthetic oligonucleotide
  Target: FXN; (-) strand; PAM type: YTN; PAM sequence: TTT
cagaaaaaatattttaccta

SEQ ID NO: 29070 - DNA, 20 bp, Artificial Sequence
  Description of Artificial Sequence: Synthetic oligonucleotide
  Target: FXN; (-) strand; PAM type: YTN; PAM sequence: TTA
tttcagaaaaaatattttac

SEQ ID NO: 29071 - DNA, 20 bp, Artificial Sequence
  Description of Artificial Sequence: Synthetic oligonucleotide
  Target: FXN; (-) strand; PAM type: YTN; PAM sequence: TTT
atttcagaaaaaatatttta

SEQ ID NO: 29072 - DNA, 20 bp, Artificial Sequence
  Description of Artificial Sequence: Synthetic oligonucleotide
  Target: FXN; (-) strand; PAM type: YTN; PAM sequence: TTT
tatttcagaaaaaatatttt

SEQ ID NO: 29073 - DNA, 20 bp, Artificial Sequence
  Description of Artificial Sequence: Synthetic oligonucleotide
  Target: FXN; (-) strand; PAM type: YTN; PAM sequence: CTC
aaaaaataattttatttcag

SEQ ID NO: 29074 - DNA, 20 bp, Artificial Sequence
  Description of Artificial Sequence: Synthetic oligonucleotide
  Target: FXN; (-) strand; PAM type: YTN; PAM sequence: TTC
catcagactcaaaaaataat

SEQ ID NO: 29075 - DNA, 20 bp, Artificial Sequence
  Description of Artificial Sequence: Synthetic oligonucleotide
  Target: FXN; (-) strand; PAM type: YTN; PAM sequence: TTT
ccatcagactcaaaaaataa

SEQ ID NO: 29076 - DNA, 20 bp, Artificial Sequence
  Description of Artificial Sequence: Synthetic oligonucleotide
  Target: FXN; (-) strand; PAM type: YTN; PAM sequence: TTA
aacatttccatcagactcaa

SEQ ID NO: 29077 - DNA, 20 bp, Artificial Sequence
  Description of Artificial Sequence: Synthetic oligonucleotide
  Target: FXN; (-) strand; PAM type: YTN; PAM sequence: CTT
aaacatttccatcagactca

SEQ ID NO: 29078 - DNA, 20 bp, Artificial Sequence
  Description of Artificial Sequence: Synthetic oligonucleotide
  Target: FXN; (-) strand; PAM type: YTN; PAM sequence: CTG
cacttaaacatttccatcag

SEQ ID NO: 29079 - DNA, 20 bp, Artificial Sequence
  Description of Artificial Sequence: Synthetic oligonucleotide
  Target: FXN; (-) strand; PAM type: YTN; PAM sequence: CTA
ctgcacttaaacatttccat

SEQ ID NO: 29080 - DNA, 20 bp, Artificial Sequence
  Description of Artificial Sequence: Synthetic oligonucleotide
  Target: FXN; (-) strand; PAM type: YTN; PAM sequence: CTG
gcctactgcacttaaacatt

SEQ ID NO: 29081 - DNA, 20 bp, Artificial Sequence
  Description of Artificial Sequence: Synthetic oligonucleotide
  Target: FXN; (-) strand; PAM type: YTN; PAM sequence: CTG
gcactggcctactgcactta

SEQ ID NO: 29082 - DNA, 20 bp, Artificial Sequence
  Description of Artificial Sequence: Synthetic oligonucleotide
  Target: FXN; (-) strand; PAM type: YTN; PAM sequence: CTC
actggcactggcctactgca

SEQ ID NO: 29083 - DNA, 20 bp, Artificial Sequence
  Description of Artificial Sequence: Synthetic oligonucleotide
  Target: FXN; (-) strand; PAM type: YTN; PAM sequence: TTC
tcactggcactggcctactg

SEQ ID NO: 29084 - DNA, 20 bp, Artificial Sequence
  Description of Artificial Sequence: Synthetic oligonucleotide
  Target: FXN; (-) strand; PAM type: YTN; PAM sequence: TTT
ctcactggcactggcctact

SEQ ID NO: 29085 - DNA, 20 bp, Artificial Sequence
  Description of Artificial Sequence: Synthetic oligonucleotide
  Target: FXN; (-) strand; PAM type: YTN; PAM sequence: TTT
tctcactggcactggcctac

SEQ ID NO: 29086 - DNA, 20 bp, Artificial Sequence
  Description of Artificial Sequence: Synthetic oligonucleotide
  Target: FXN; (-) strand; PAM type: YTN; PAM sequence: TTA
ttttctcactggcactggcc

SEQ ID NO: 29087 - DNA, 20 bp, Artificial Sequence
  Description of Artificial Sequence: Synthetic oligonucleotide
  Target: FXN; (-) strand; PAM type: YTN; PAM sequence: TTT
attttctcactggcactggc

SEQ ID NO: 29088 - DNA, 20 bp, Artificial Sequence
  Description of Artificial Sequence: Synthetic oligonucleotide
  Target: FXN; (-) strand; PAM type: YTN; PAM sequence: TTA
tttattttctcactggcact

SEQ ID NO: 29089 - DNA, 20 bp, Artificial Sequence
  Description of Artificial Sequence: Synthetic oligonucleotide
  Target: FXN; (-) strand; PAM type: YTN; PAM sequence: TTC
agtagaagcaagatgcaaac

SEQ ID NO: 29090 - DNA, 20 bp, Artificial Sequence
  Description of Artificial Sequence: Synthetic oligonucleotide
  Target: FXN; (-) strand; PAM type: YTN; PAM sequence: TTT
cagtagaagcaagatgcaaa

SEQ ID NO: 29091 - DNA, 20 bp, Artificial Sequence
  Description of Artificial Sequence: Synthetic oligonucleotide
  Target: FXN; (-) strand; PAM type: YTN; PAM sequence: CTT
tcagtagaagcaagatgcaa

SEQ ID NO: 29092 - DNA, 20 bp, Artificial Sequence
  Description of Artificial Sequence: Synthetic oligonucleotide
  Target: FXN; (-) strand; PAM type: YTN; PAM sequence: CTG
aaactttcagtagaagcaag

SEQ ID NO: 29093 - DNA, 20 bp, Artificial Sequence
  Description of Artificial Sequence: Synthetic oligonucleotide
  Target: FXN; (-) strand; PAM type: YTN; PAM sequence: CTA
agtaagtggggtgcactgaa

SEQ ID NO: 29094 - DNA, 20 bp, Artificial Sequence
  Description of Artificial Sequence: Synthetic oligonucleotide
  Target: FXN; (-) strand; PAM type: YTN; PAM sequence: TTC
taagtaagtggggtgcactg

SEQ ID NO: 29095 - DNA, 20 bp, Artificial Sequence
  Description of Artificial Sequence: Synthetic oligonucleotide
  Target: FXN; (-) strand; PAM type: YTN; PAM sequence: CTG
tgtcccagataaaggagtac

SEQ ID NO: 29096 - DNA, 20 bp, Artificial Sequence
  Description of Artificial Sequence: Synthetic oligonucleotide
  Target: FXN; (-) strand; PAM type: YTN; PAM sequence: TTG
tgctgtgtcccagataaagg

SEQ ID NO: 29097 - DNA, 20 bp, Artificial Sequence
  Description of Artificial Sequence: Synthetic oligonucleotide
  Target: FXN; (-) strand; PAM type: YTN; PAM sequence: TTT
gtgctgtgtcccagataaag

SEQ ID NO: 29098 - DNA, 20 bp, Artificial Sequence
  Description of Artificial Sequence: Synthetic oligonucleotide
  Target: FXN; (-) strand; PAM type: YTN; PAM sequence: TTT
tgtgctgtgtcccagataaa

SEQ ID NO: 29099 - DNA, 20 bp, Artificial Sequence
  Description of Artificial Sequence: Synthetic oligonucleotide
  Target: FXN; (-) strand; PAM type: YTN; PAM sequence: CTT
ttgtgctgtgtcccagataa

SEQ ID NO: 29100 - DNA, 20 bp, Artificial Sequence
  Description of Artificial Sequence: Synthetic oligonucleotide
  Target: FXN; (-) strand; PAM type: YTN; PAM sequence: CTC
ttttgtgctgtgtcccagat

SEQ ID NO: 29101 - DNA, 20 bp, Artificial Sequence
  Description of Artificial Sequence: Synthetic oligonucleotide
  Target: FXN; (-) strand; PAM type: YTN; PAM sequence: CTG
catacctcttttgtgctgtg

SEQ ID NO: 29102 - DNA, 20 bp, Artificial Sequence
  Description of Artificial Sequence: Synthetic oligonucleotide
  Target: FXN; (-) strand; PAM type: YTN; PAM sequence: TTC
atgtcagagcagccccactg

SEQ ID NO: 29103 - DNA, 20 bp, Artificial Sequence
  Description of Artificial Sequence: Synthetic oligonucleotide
  Target: FXN; (-) strand; PAM type: YTN; PAM sequence: TTT
catgtcagagcagccccact

SEQ ID NO: 29104 - DNA, 20 bp, Artificial Sequence
  Description of Artificial Sequence: Synthetic oligonucleotide
  Target: FXN; (-) strand; PAM type: YTN; PAM sequence: CTT
tcatgtcagagcagccccac

SEQ ID NO: 29105 - DNA, 20 bp, Artificial Sequence
  Description of Artificial Sequence: Synthetic oligonucleotide
  Target: FXN; (-) strand; PAM type: YTN; PAM sequence: TTC
cactttcatgtcagagcagc

SEQ ID NO: 29106 - DNA, 20 bp, Artificial Sequence
  Description of Artificial Sequence: Synthetic oligonucleotide
  Target: FXN; (-) strand; PAM type: YTN; PAM sequence: CTT
ccactttcatgtcagagcag

SEQ ID NO: 29107 - DNA, 20 bp, Artificial Sequence
  Description of Artificial Sequence: Synthetic oligonucleotide
  Target: FXN; (-) strand; PAM type: YTN; PAM sequence: TTA
acttccactttcatgtcaga

SEQ ID NO: 29108 - DNA, 20 bp, Artificial Sequence
  Description of Artificial Sequence: Synthetic oligonucleotide
  Target: FXN; (-) strand; PAM type: YTN; PAM sequence: CTT
aacttccactttcatgtcag

SEQ ID NO: 29109 - DNA, 20 bp, Artificial Sequence
  Description of Artificial Sequence: Synthetic oligonucleotide
  Target: FXN; (-) strand; PAM type: YTN; PAM sequence: TTC
cttaacttccactttcatgt

SEQ ID NO: 29110 - DNA, 20 bp, Artificial Sequence
  Description of Artificial Sequence: Synthetic oligonucleotide
  Target: FXN; (-) strand; PAM type: YTN; PAM sequence: CTG
gcccacaaggaccccataag

SEQ ID NO: 29111 - DNA, 20 bp, Artificial Sequence
  Description of Artificial Sequence: Synthetic oligonucleotide
  Target: FXN; (-) strand; PAM type: YTN; PAM sequence: CTG
aagggctggcccacaaggac

SEQ ID NO: 29112 - DNA, 20 bp, Artificial Sequence
  Description of Artificial Sequence: Synthetic oligonucleotide
  Target: FXN; (-) strand; PAM type: YTN; PAM sequence: CTA
tatgtaaaatgaaagtaaaa

SEQ ID NO: 29113 - DNA, 20 bp, Artificial Sequence
  Description of Artificial Sequence: Synthetic oligonucleotide
  Target: FXN; (-) strand; PAM type: YTN; PAM sequence: TTA
gagctatatgtaaaatgaaa

SEQ ID NO: 29114 - DNA, 20 bp, Artificial Sequence
  Description of Artificial Sequence: Synthetic oligonucleotide
  Target: FXN; (-) strand; PAM type: YTN; PAM sequence: TTG
ggaacgagataatcaaacca

SEQ ID NO: 29115 - DNA, 20 bp, Artificial Sequence
  Description of Artificial Sequence: Synthetic oligonucleotide
  Target: FXN; (-) strand; PAM type: YTN; PAM sequence: CTT
gggaacgagataatcaaacc

SEQ ID NO: 29116 - DNA, 20 bp, Artificial Sequence
  Description of Artificial Sequence: Synthetic oligonucleotide
  Target: FXN; (-) strand; PAM type: YTN; PAM sequence: CTG
ccttgggaacgagataatca

SEQ ID NO: 29117 - DNA, 20 bp, Artificial Sequence
  Description of Artificial Sequence: Synthetic oligonucleotide
  Target: FXN; (-) strand; PAM type: YTN; PAM sequence: CTC
ccactgccttgggaacgaga

SEQ ID NO: 29118 - DNA, 20 bp, Artificial Sequence
  Description of Artificial Sequence: Synthetic oligonucleotide
  Target: FXN; (-) strand; PAM type: YTN; PAM sequence: TTA
aatggggatctcccactgcc

SEQ ID NO: 29119 - DNA, 20 bp, Artificial Sequence
  Description of Artificial Sequence: Synthetic oligonucleotide
  Target: FXN; (-) strand; PAM type: YTN; PAM sequence: CTT
aaatggggatctcccactgc

SEQ ID NO: 29120 - DNA, 20 bp, Artificial Sequence
  Description of Artificial Sequence: Synthetic oligonucleotide
  Target: FXN; (-) strand; PAM type: YTN; PAM sequence: TTC
cttaaatggggatctcccac

SEQ ID NO: 29121 - DNA, 20 bp, Artificial Sequence
  Description of Artificial Sequence: Synthetic oligonucleotide
  Target: FXN; (-) strand; PAM type: YTN; PAM sequence: TTT
ccttaaatggggatctccca

SEQ ID NO: 29122 - DNA, 20 bp, Artificial Sequence
  Description of Artificial Sequence: Synthetic oligonucleotide
  Target: FXN; (-) strand; PAM type: YTN; PAM sequence: CTT
tccttaaatggggatctccc

SEQ ID NO: 29123 - DNA, 20 bp, Artificial Sequence
  Description of Artificial Sequence: Synthetic oligonucleotide
  Target: FXN; (-) strand; PAM type: YTN; PAM sequence: TTC
tttccttaaatggggatctc

SEQ ID NO: 29124 - DNA, 20 bp, Artificial Sequence
  Description of Artificial Sequence: Synthetic oligonucleotide
  Target: FXN; (-) strand; PAM type: YTN; PAM sequence: TTT
ctttccttaaatggggatct

SEQ ID NO: 29125 - DNA, 20 bp, Artificial Sequence
  Description of Artificial Sequence: Synthetic oligonucleotide
  Target: FXN; (-) strand; PAM type: YTN; PAM sequence: TTT
tctttccttaaatggggatc

SEQ ID NO: 29126 - DNA, 20 bp, Artificial Sequence
  Description of Artificial Sequence: Synthetic oligonucleotide
  Target: FXN; (-) strand; PAM type: YTN; PAM sequence: CTT
ttctttccttaaatggggat

SEQ ID NO: 29127 - DNA, 20 bp, Artificial Sequence
  Description of Artificial Sequence: Synthetic oligonucleotide
  Target: FXN; (-) strand; PAM type: YTN; PAM sequence: CTG
tgccaggccccttttctttc

SEQ ID NO: 29128 - DNA, 20 bp, Artificial Sequence
  Description of Artificial Sequence: Synthetic oligonucleotide
  Target: FXN; (-) strand; PAM type: YTN; PAM sequence: TTA
caggcatgagccactgtgcc

SEQ ID NO: 29129 - DNA, 20 bp, Artificial Sequence
  Description of Artificial Sequence: Synthetic oligonucleotide
  Target: FXN; (-) strand; PAM type: YTN; PAM sequence: CTG
ggattacaggcatgagccac

SEQ ID NO: 29130 - DNA, 20 bp, Artificial Sequence
  Description of Artificial Sequence: Synthetic oligonucleotide
  Target: FXN; (-) strand; PAM type: YTN; PAM sequence: CTC
ccaaagtgctgggattacag

SEQ ID NO: 29131 - DNA, 20 bp, Artificial Sequence
  Description of Artificial Sequence: Synthetic oligonucleotide
  Target: FXN; (-) strand; PAM type: YTN; PAM sequence: CTC
agcctcccaaagtgctggga

SEQ ID NO: 29132 - DNA, 20 bp, Artificial Sequence
  Description of Artificial Sequence: Synthetic oligonucleotide
  Target: FXN; (-) strand; PAM type: YTN; PAM sequence: TTG
cctcagcctcccaaagtgct

SEQ ID NO: 29133 - DNA, 20 bp, Artificial Sequence
  Description of Artificial Sequence: Synthetic oligonucleotide
  Target: FXN; (-) strand; PAM type: YTN; PAM sequence: CTT
gcctcagcctcccaaagtgc

SEQ ID NO: 29134 - DNA, 20 bp, Artificial Sequence
  Description of Artificial Sequence: Synthetic oligonucleotide
  Target: FXN; (-) strand; PAM type: YTN; PAM sequence: CTC
aggtgatacacttgcctcag

SEQ ID NO: 29135 - DNA, 20 bp, Artificial Sequence
  Description of Artificial Sequence: Synthetic oligonucleotide
  Target: FXN; (-) strand; PAM type: YTN; PAM sequence: CTG
acctcaggtgatacacttgc

SEQ ID NO: 29136 - DNA, 20 bp, Artificial Sequence
  Description of Artificial Sequence: Synthetic oligonucleotide
  Target: FXN; (-) strand; PAM type: YTN; PAM sequence: CTC
ctgacctcaggtgatacact

SEQ ID NO: 29137 - DNA, 20 bp, Artificial Sequence
  Description of Artificial Sequence: Synthetic oligonucleotide
  Target: FXN; (-) strand; PAM type: YTN; PAM sequence: TTG
aactcctgacctcaggtgat

SEQ ID NO: 29138 - DNA, 20 bp, Artificial Sequence
  Description of Artificial Sequence: Synthetic oligonucleotide
  Target: FXN; (-) strand; PAM type: YTN; PAM sequence: CTT
gaactcctgacctcaggtga

SEQ ID NO: 29139 - DNA, 20 bp, Artificial Sequence
  Description of Artificial Sequence: Synthetic oligonucleotide
  Target: FXN; (-) strand; PAM type: YTN; PAM sequence: CTG
gtcttgaactcctgacctca

SEQ ID NO: 29140 - DNA, 20 bp, Artificial Sequence
  Description of Artificial Sequence: Synthetic oligonucleotide
  Target: FXN; (-) strand; PAM type: YTN; PAM sequence: TTG
gccaggctggtcttgaactc

SEQ ID NO: 29141 - DNA, 20 bp, Artificial Sequence
  Description of Artificial Sequence: Synthetic oligonucleotide
  Target: FXN; (-) strand; PAM type: YTN; PAM sequence: TTG
ccatgttggccaggctggtc

SEQ ID NO: 29142 - DNA, 20 bp, Artificial Sequence
  Description of Artificial Sequence: Synthetic oligonucleotide
  Target: FXN; (-) strand; PAM type: YTN; PAM sequence: TTT
gccatgttggccaggctggt

SEQ ID NO: 29143 - DNA, 20 bp, Artificial Sequence
  Description of Artificial Sequence: Synthetic oligonucleotide
  Target: FXN; (-) strand; PAM type: YTN; PAM sequence: TTT
tgccatgttggccaggctgg

SEQ ID NO: 29144 - DNA, 20 bp, Artificial Sequence
  Description of Artificial Sequence: Synthetic oligonucleotide
  Target: FXN; (-) strand; PAM type: YTN; PAM sequence: TTA
gtagagacgggattttgcca

SEQ ID NO: 29145 - DNA, 20 bp, Artificial Sequence
  Description of Artificial Sequence: Synthetic oligonucleotide
  Target: FXN; (-) strand; PAM type: YTN; PAM sequence: TTT
agtagagacgggattttgcc

SEQ ID NO: 29146 - DNA, 20 bp, Artificial Sequence
  Description of Artificial Sequence: Synthetic oligonucleotide
  Target: FXN; (-) strand; PAM type: YTN; PAM sequence: TTT
tagtagagacgggattttgc

SEQ ID NO: 29147 - DNA, 20 bp, Artificial Sequence
  Description of Artificial Sequence: Synthetic oligonucleotide
  Target: FXN; (-) strand; PAM type: YTN; PAM sequence: TTT
ttagtagagacgggattttg

SEQ ID NO: 29148 - DNA, 20 bp, Artificial Sequence
  Description of Artificial Sequence: Synthetic oligonucleotide
  Target: FXN; (-) strand; PAM type: YTN; PAM sequence: TTA
atatttttagtagagacggg

SEQ ID NO: 29149 - DNA, 20 bp, Artificial Sequence
  Description of Artificial Sequence: Synthetic oligonucleotide
  Target: FXN; (-) strand; PAM type: YTN; PAM sequence: TTT
aatatttttagtagagacgg

SEQ ID NO: 29150 - DNA, 20 bp, Artificial Sequence
  Description of Artificial Sequence: Synthetic oligonucleotide
  Target: FXN; (-) strand; PAM type: YTN; PAM sequence: TTT
taatatttttagtagagacg

SEQ ID NO: 29151 - DNA, 20 bp, Artificial Sequence
  Description of Artificial Sequence: Synthetic oligonucleotide
  Target: FXN; (-) strand; PAM type: YTN; PAM sequence: TTT
ttaatatttttagtagagac

SEQ ID NO: 29152 - DNA, 20 bp, Artificial Sequence
  Description of Artificial Sequence: Synthetic oligonucleotide
  Target: FXN; (-) strand; PAM type: YTN; PAM sequence: TTT
tttaatatttttagtagaga

SEQ ID NO: 29153 - DNA, 20 bp, Artificial Sequence
  Description of Artificial Sequence: Synthetic oligonucleotide
  Target: FXN; (-) strand; PAM type: YTN; PAM sequence: TTA
taggcacgaaccaccacgcc

SEQ ID NO: 29154 - DNA, 20 bp, Artificial Sequence
  Description of Artificial Sequence: Synthetic oligonucleotide
  Target: FXN; (-) strand; PAM type: YTN; PAM sequence: CTG
aaattataggcacgaaccac

SEQ ID NO: 29155 - DNA, 20 bp, Artificial Sequence
  Description of Artificial Sequence: Synthetic oligonucleotide
  Target: FXN; (-) strand; PAM type: YTN; PAM sequence: CTG
agtagctgaaattataggca

SEQ ID NO: 29156 - DNA, 20 bp, Artificial Sequence
  Description of Artificial Sequence: Synthetic oligonucleotide
  Target: FXN; (-) strand; PAM type: YTN; PAM sequence: CTC
ctgagtagctgaaattatag

SEQ ID NO: 29157 - DNA, 20 bp, Artificial Sequence
  Description of Artificial Sequence: Synthetic oligonucleotide
  Target: FXN; (-) strand; PAM type: YTN; PAM sequence: CTC
agcctcctgagtagctgaaa

SEQ ID NO: 29158 - DNA, 20 bp, Artificial Sequence
  Description of Artificial Sequence: Synthetic oligonucleotide
  Target: FXN; (-) strand; PAM type: YTN; PAM sequence: CTG
cctcagcctcctgagtagct

SEQ ID NO: 29159 - DNA, 20 bp, Artificial Sequence
  Description of Artificial Sequence: Synthetic oligonucleotide
  Target: FXN; (-) strand; PAM type: YTN; PAM sequence: CTC
ctgcctcagcctcctgagta

SEQ ID NO: 29160 - DNA, 20 bp, Artificial Sequence
  Description of Artificial Sequence: Synthetic oligonucleotide
  Target: FXN; (-) strand; PAM type: YTN; PAM sequence: TTC
tcctgcctcagcctcctgag

SEQ ID NO: 29161 - DNA, 20 bp, Artificial Sequence
  Description of Artificial Sequence: Synthetic oligonucleotide
  Target: FXN; (-) strand; PAM type: YTN; PAM sequence: TTA
cagcgattctcctgcctcag

SEQ ID NO: 29162 - DNA, 20 bp, Artificial Sequence
  Description of Artificial Sequence: Synthetic oligonucleotide
  Target: FXN; (-) strand; PAM type: YTN; PAM sequence: CTC
caccccccaggttacagcga

SEQ ID NO: 29163 - DNA, 20 bp, Artificial Sequence
  Description of Artificial Sequence: Synthetic oligonucleotide
  Target: FXN; (-) strand; PAM type: YTN; PAM sequence: CTG
caacctccaccccccaggtt

SEQ ID NO: 29164 - DNA, 20 bp, Artificial Sequence
  Description of Artificial Sequence: Synthetic oligonucleotide
  Target: FXN; (-) strand; PAM type: YTN; PAM sequence: CTC
actgcaacctccacccccca

SEQ ID NO: 29165 - DNA, 20 bp, Artificial Sequence
  Description of Artificial Sequence: Synthetic oligonucleotide
  Target: FXN; (-) strand; PAM type: YTN; PAM sequence: CTC
gtctcactgcaacctccacc

SEQ ID NO: 29166 - DNA, 20 bp, Artificial Sequence
  Description of Artificial Sequence: Synthetic oligonucleotide
  Target: FXN; (-) strand; PAM type: YTN; PAM sequence: CTG
gagtgaagtggcatgatctc

SEQ ID NO: 29167 - DNA, 20 bp, Artificial Sequence
  Description of Artificial Sequence: Synthetic oligonucleotide
  Target: FXN; (-) strand; PAM type: YTN; PAM sequence: TTG
gccaggctggagtgaagtgg

SEQ ID NO: 29168 - DNA, 20 bp, Artificial Sequence
  Description of Artificial Sequence: Synthetic oligonucleotide
  Target: FXN; (-) strand; PAM type: YTN; PAM sequence: CTG
ttggccaggctggagtgaag

SEQ ID NO: 29169 - DNA, 20 bp, Artificial Sequence
  Description of Artificial Sequence: Synthetic oligonucleotide
  Target: FXN; (-) strand; PAM type: YTN; PAM sequence: CTC
tgttggccaggctggagtga

SEQ ID NO: 29170 - DNA, 20 bp, Artificial Sequence
  Description of Artificial Sequence: Synthetic oligonucleotide
  Target: FXN; (-) strand; PAM type: YTN; PAM sequence: TTG
agacggagtatggctctgtt

SEQ ID NO: 29171 - DNA, 20 bp, Artificial Sequence
  Description of Artificial Sequence: Synthetic oligonucleotide
  Target: FXN; (-) strand; PAM type: YTN; PAM sequence: TTT
gagacggagtatggctctgt

SEQ ID NO: 29172 - DNA, 20 bp, Artificial Sequence
  Description of Artificial Sequence: Synthetic oligonucleotide
  Target: FXN; (-) strand; PAM type: YTN; PAM sequence: TTA
tttgagacggagtatggctc

SEQ ID NO: 29173 - DNA, 20 bp, Artificial Sequence
  Description of Artificial Sequence: Synthetic oligonucleotide
  Target: FXN; (-) strand; PAM type: YTN; PAM sequence: TTT
atttgagacggagtatggct

SEQ ID NO: 29174 - DNA, 20 bp, Artificial Sequence
  Description of Artificial Sequence: Synthetic oligonucleotide
  Target: FXN; (-) strand; PAM type: YTN; PAM sequence: TTA
tttatttgagacggagtatg

SEQ ID NO: 29175 - DNA, 20 bp, Artificial Sequence
  Description of Artificial Sequence: Synthetic oligonucleotide
  Target: FXN; (-) strand; PAM type: YTN; PAM sequence: TTT
atttatttgagacggagtat

SEQ ID NO: 29176 - DNA, 20 bp, Artificial Sequence
  Description of Artificial Sequence: Synthetic oligonucleotide
  Target: FXN; (-) strand; PAM type: YTN; PAM sequence: TTA
tttatttatttgagacggag

SEQ ID NO: 29177 - DNA, 20 bp, Artificial Sequence
  Description of Artificial Sequence: Synthetic oligonucleotide
  Target: FXN; (-) strand; PAM type: YTN; PAM sequence: TTT
atttatttatttgagacgga

SEQ ID NO: 29178 - DNA, 20 bp, Artificial Sequence
  Description of Artificial Sequence: Synthetic oligonucleotide
  Target: FXN; (-) strand; PAM type: YTN; PAM sequence: TTA
tttatttatttatttgagac

SEQ ID NO: 29179 - DNA, 20 bp, Artificial Sequence
  Description of Artificial Sequence: Synthetic oligonucleotide
  Target: FXN; (-) strand; PAM type: YTN; PAM sequence: TTT
atttatttatttatttgaga

SEQ ID NO: 29180 - DNA, 20 bp, Artificial Sequence
  Description of Artificial Sequence: Synthetic oligonucleotide
  Target: FXN; (-) strand; PAM type: YTN; PAM sequence: TTA
tttatttatttatttatttg

SEQ ID NO: 29181 - DNA, 20 bp, Artificial Sequence
  Description of Artificial Sequence: Synthetic oligonucleotide
  Target: FXN; (-) strand; PAM type: YTN; PAM sequence: TTT
atttatttatttatttattt

SEQ ID NO: 29182 - DNA, 20 bp, Artificial Sequence
  Description of Artificial Sequence: Synthetic oligonucleotide
  Target: FXN; (-) strand; PAM type: YTN; PAM sequence: CTT
tatttatttatttatttatt

SEQ ID NO: 29183 - DNA, 20 bp, Artificial Sequence
  Description of Artificial Sequence: Synthetic oligonucleotide
  Target: FXN; (-) strand; PAM type: YTN; PAM sequence: TTG
aagtccctttatttatttat

SEQ ID NO: 29184 - DNA, 20 bp, Artificial Sequence
  Description of Artificial Sequence: Synthetic oligonucleotide
  Target: FXN; (-) strand; PAM type: YTN; PAM sequence: TTT
gaagtccctttatttattta

SEQ ID NO: 29185 - DNA, 20 bp, Artificial Sequence
  Description of Artificial Sequence: Synthetic oligonucleotide
  Target: FXN; (-) strand; PAM type: YTN; PAM sequence: TTC
atgtgtttgaagtcccttta

SEQ ID NO: 29186 - DNA, 20 bp, Artificial Sequence
  Description of Artificial Sequence: Synthetic oligonucleotide
  Target: FXN; (-) strand; PAM type: YTN; PAM sequence: CTG
ttcatgtgtttgaagtccct

SEQ ID NO: 29187 - DNA, 20 bp, Artificial Sequence
  Description of Artificial Sequence: Synthetic oligonucleotide
  Target: FXN; (-) strand; PAM type: YTN; PAM sequence: CTG
ctgttcatgtgtttgaagtc

SEQ ID NO: 29188 - DNA, 20 bp, Artificial Sequence
  Description of Artificial Sequence: Synthetic oligonucleotide
  Target: FXN; (-) strand; PAM type: YTN; PAM sequence: CTG
gctgctgttcatgtgtttga

SEQ ID NO: 29189 - DNA, 20 bp, Artificial Sequence
  Description of Artificial Sequence: Synthetic oligonucleotide
  Target: FXN; (-) strand; PAM type: YTN; PAM sequence: TTC
ccctggctgctgttcatgtg

SEQ ID NO: 29190 - DNA, 20 bp, Artificial Sequence
  Description of Artificial Sequence: Synthetic oligonucleotide
  Target: FXN; (-) strand; PAM type: YTN; PAM sequence: CTT
cccctggctgctgttcatgt

SEQ ID NO: 29191 - DNA, 20 bp, Artificial Sequence
  Description of Artificial Sequence: Synthetic oligonucleotide
  Target: FXN; (-) strand; PAM type: YTN; PAM sequence: TTC
ttcccctggctgctgttcat

SEQ ID NO: 29192 - DNA, 20 bp, Artificial Sequence
  Description of Artificial Sequence: Synthetic oligonucleotide
  Target: FXN; (-) strand; PAM type: YTN; PAM sequence: TTG
attcttcccctggctgctgt

SEQ ID NO: 29193 - DNA, 20 bp, Artificial Sequence
  Description of Artificial Sequence: Synthetic oligonucleotide
  Target: FXN; (-) strand; PAM type: YTN; PAM sequence: TTT
gattcttcccctggctgctg

SEQ ID NO: 29194 - DNA, 20 bp, Artificial Sequence
  Description of Artificial Sequence: Synthetic oligonucleotide
  Target: FXN; (-) strand; PAM type: YTN; PAM sequence: TTT
tgattcttcccctggctgct

SEQ ID NO: 29195 - DNA, 20 bp, Artificial Sequence
  Description of Artificial Sequence: Synthetic oligonucleotide
  Target: FXN; (-) strand; PAM type: YTN; PAM sequence: TTG
acagaatatgattttgattc

SEQ ID NO: 29196 - DNA, 20 bp, Artificial Sequence
  Description of Artificial Sequence: Synthetic oligonucleotide
  Target: FXN; (-) strand; PAM type: YTN; PAM sequence: CTT
gacagaatatgattttgatt

SEQ ID NO: 29197 - DNA, 20 bp, Artificial Sequence
  Description of Artificial Sequence: Synthetic oligonucleotide
  Target: FXN; (-) strand; PAM type: YTN; PAM sequence: TTG
cttgacagaatatgattttg

SEQ ID NO: 29198 - DNA, 20 bp, Artificial Sequence
  Description of Artificial Sequence: Synthetic oligonucleotide
  Target: FXN; (-) strand; PAM type: YTN; PAM sequence: TTT
gcttgacagaatatgatttt

SEQ ID NO: 29199 - DNA, 20 bp, Artificial Sequence
  Description of Artificial Sequence: Synthetic oligonucleotide
  Target: FXN; (-) strand; PAM type: YTN; PAM sequence: TTC
cagtttgcttgacagaatat

SEQ ID NO: 29200 - DNA, 20 bp, Artificial Sequence
  Description of Artificial Sequence: Synthetic oligonucleotide
  Target: FXN; (-) strand; PAM type: YTN; PAM sequence: TTT
ccagtttgcttgacagaata

SEQ ID NO: 29201 - DNA, 20 bp, Artificial Sequence
  Description of Artificial Sequence: Synthetic oligonucleotide
  Target: FXN; (-) strand; PAM type: YTN; PAM sequence: TTT
tccagtttgcttgacagaat

SEQ ID NO: 29202 - DNA, 20 bp, Artificial Sequence
  Description of Artificial Sequence: Synthetic oligonucleotide
  Target: FXN; (-) strand; PAM type: YTN; PAM sequence: CTT
ttccagtttgcttgacagaa

SEQ ID NO: 29203 - DNA, 20 bp, Artificial Sequence
  Description of Artificial Sequence: Synthetic oligonucleotide
  Target: FXN; (-) strand; PAM type: YTN; PAM sequence: TTG
gtacacacagtggtactttt

SEQ ID NO: 29204 - DNA, 20 bp, Artificial Sequence
  Description of Artificial Sequence: Synthetic oligonucleotide
  Target: FXN; (-) strand; PAM type: YTN; PAM sequence: CTA
ttggtacacacagtggtact

SEQ ID NO: 29205 - DNA, 20 bp, Artificial Sequence
  Description of Artificial Sequence: Synthetic oligonucleotide
  Target: FXN; (-) strand; PAM type: YTN; PAM sequence: CTG
tggtggggaggctattggta

SEQ ID NO: 29206 - DNA, 20 bp, Artificial Sequence
  Description of Artificial Sequence: Synthetic oligonucleotide
  Target: FXN; (-) strand; PAM type: YTN; PAM sequence: CTC
ccagggtctgtggtggggag

SEQ ID NO: 29207 - DNA, 20 bp, Artificial Sequence
  Description of Artificial Sequence: Synthetic oligonucleotide
  Target: FXN; (-) strand; PAM type: YTN; PAM sequence: CTG
gaccacaccataaatgaggc

SEQ ID NO: 29208 - DNA, 20 bp, Artificial Sequence
  Description of Artificial Sequence: Synthetic oligonucleotide
  Target: FXN; (-) strand; PAM type: YTN; PAM sequence: TTC
acatggatgactggaccaca

SEQ ID NO: 29209 - DNA, 20 bp, Artificial Sequence
  Description of Artificial Sequence: Synthetic oligonucleotide
  Target: FXN; (-) strand; PAM type: YTN; PAM sequence: CTT
cacatggatgactggaccac

SEQ ID NO: 29210 - DNA, 20 bp, Artificial Sequence
  Description of Artificial Sequence: Synthetic oligonucleotide
  Target: FXN; (-) strand; PAM type: YTN; PAM sequence: CTC
atccttcacatggatgactg

SEQ ID NO: 29211 - DNA, 20 bp, Artificial Sequence
  Description of Artificial Sequence: Synthetic oligonucleotide
  Target: FXN; (-) strand; PAM type: YTN; PAM sequence: CTG
gaaactcatccttcacatgg

SEQ ID NO: 29212 - DNA, 20 bp, Artificial Sequence
  Description of Artificial Sequence: Synthetic oligonucleotide
  Target: FXN; (-) strand; PAM type: YTN; PAM sequence: TTC
ctggaaactcatccttcaca

SEQ ID NO: 29213 - DNA, 20 bp, Artificial Sequence
  Description of Artificial Sequence: Synthetic oligonucleotide
  Target: FXN; (-) strand; PAM type: YTN; PAM sequence: TTT
cctggaaactcatccttcac

SEQ ID NO: 29214 - DNA, 20 bp, Artificial Sequence
  Description of Artificial Sequence: Synthetic oligonucleotide
  Target: FXN; (-) strand; PAM type: YTN; PAM sequence: TTT
tcctggaaactcatccttca

SEQ ID NO: 29215 - DNA, 20 bp, Artificial Sequence
  Description of Artificial Sequence: Synthetic oligonucleotide
  Target: FXN; (-) strand; PAM type: YTN; PAM sequence: CTT
ttcctggaaactcatccttc

SEQ ID NO: 29216 - DNA, 20 bp, Artificial Sequence
  Description of Artificial Sequence: Synthetic oligonucleotide
  Target: FXN; (-) strand; PAM type: YTN; PAM sequence: TTA
ataaccttttcctggaaact

SEQ ID NO: 29217 - DNA, 20 bp, Artificial Sequence
  Description of Artificial Sequence: Synthetic oligonucleotide
  Target: FXN; (-) strand; PAM type: YTN; PAM sequence: TTT
aataaccttttcctggaaac

SEQ ID NO: 29218 - DNA, 20 bp, Artificial Sequence
  Description of Artificial Sequence: Synthetic oligonucleotide
  Target: FXN; (-) strand; PAM type: YTN; PAM sequence: TTA
cagtgaatatttaataacct

SEQ ID NO: 29219 - DNA, 20 bp, Artificial Sequence
  Description of Artificial Sequence: Synthetic oligonucleotide
  Target: FXN; (-) strand; PAM type: YTN; PAM sequence: CTC
cagtatgttacagtgaatat

SEQ ID NO: 29220 - DNA, 20 bp, Artificial Sequence
  Description of Artificial Sequence: Synthetic oligonucleotide
  Target: FXN; (-) strand; PAM type: YTN; PAM sequence: CTC
ctccagtatgttacagtgaa

SEQ ID NO: 29221 - DNA, 20 bp, Artificial Sequence
  Description of Artificial Sequence: Synthetic oligonucleotide
  Target: FXN; (-) strand; PAM type: YTN; PAM sequence: CTC
acctcctccagtatgttaca

SEQ ID NO: 29222 - DNA, 20 bp, Artificial Sequence
  Description of Artificial Sequence: Synthetic oligonucleotide
  Target: FXN; (-) strand; PAM type: YTN; PAM sequence: TTC
ctcacctcctccagtatgtt

SEQ ID NO: 29223 - DNA, 20 bp, Artificial Sequence
  Description of Artificial Sequence: Synthetic oligonucleotide
  Target: FXN; (-) strand; PAM type: YTN; PAM sequence: TTA
tgcaattcctcacctcctcc

SEQ ID NO: 29224 - DNA, 20 bp, Artificial Sequence
  Description of Artificial Sequence: Synthetic oligonucleotide
  Target: FXN; (-) strand; PAM type: YTN; PAM sequence: TTG
tattatgcaattcctcacct

SEQ ID NO: 29225 - DNA, 20 bp, Artificial Sequence
  Description of Artificial Sequence: Synthetic oligonucleotide
  Target: FXN; (-) strand; PAM type: YTN; PAM sequence: CTA
agattgtattatgcaattcc

SEQ ID NO: 29226 - DNA, 20 bp, Artificial Sequence
  Description of Artificial Sequence: Synthetic oligonucleotide
  Target: FXN; (-) strand; PAM type: YTN; PAM sequence: TTC
taagattgtattatgcaatt

SEQ ID NO: 29227 - DNA, 20 bp, Artificial Sequence
  Description of Artificial Sequence: Synthetic oligonucleotide
  Target: FXN; (-) strand; PAM type: YTN; PAM sequence: TTT
ctaagattgtattatgcaat

SEQ ID NO: 29228 - DNA, 20 bp, Artificial Sequence
  Description of Artificial Sequence: Synthetic oligonucleotide
  Target: FXN; (-) strand; PAM type: YTN; PAM sequence: TTT
tctaagattgtattatgcaa

SEQ ID NO: 29229 - DNA, 20 bp, Artificial Sequence
  Description of Artificial Sequence: Synthetic oligonucleotide
  Target: FXN; (-) strand; PAM type: YTN; PAM sequence: CTC
aaaaaatagaaaggggaaaa

SEQ ID NO: 29230 - DNA, 20 bp, Artificial Sequence
  Description of Artificial Sequence: Synthetic oligonucleotide
  Target: FXN; (-) strand; PAM type: YTN; PAM sequence: CTG
tctcaaaaaatagaaagggg

SEQ ID NO: 29231 - DNA, 20 bp, Artificial Sequence
  Description of Artificial Sequence: Synthetic oligonucleotide
  Target: FXN; (-) strand; PAM type: YTN; PAM sequence: CTG
agtgccaaagtgagatcctg

SEQ ID NO: 29232 - DNA, 20 bp, Artificial Sequence
  Description of Artificial Sequence: Synthetic oligonucleotide
  Target: FXN; (-) strand; PAM type: YTN; PAM sequence: CTC
cagcctgagtgccaaagtga

SEQ ID NO: 29233 - DNA, 20 bp, Artificial Sequence
  Description of Artificial Sequence: Synthetic oligonucleotide
  Target: FXN; (-) strand; PAM type: YTN; PAM sequence: CTG
tcctccagcctgagtgccaa

SEQ ID NO: 29234 - DNA, 20 bp, Artificial Sequence
  Description of Artificial Sequence: Synthetic oligonucleotide
  Target: FXN; (-) strand; PAM type: YTN; PAM sequence: TTG
taccactgtcctccagcctg

SEQ ID NO: 29235 - DNA, 20 bp, Artificial Sequence
  Description of Artificial Sequence: Synthetic oligonucleotide
  Target: FXN; (-) strand; PAM type: YTN; PAM sequence: TTG
attgtaccactgtcctccag

SEQ ID NO: 29236 - DNA, 20 bp, Artificial Sequence
  Description of Artificial Sequence: Synthetic oligonucleotide
  Target: FXN; (-) strand; PAM type: YTN; PAM sequence: TTT
gattgtaccactgtcctcca

SEQ ID NO: 29237 - DNA, 20 bp, Artificial Sequence
  Description of Artificial Sequence: Synthetic oligonucleotide
  Target: FXN; (-) strand; PAM type: YTN; PAM sequence: CTT
tgattgtaccactgtcctcc

SEQ ID NO: 29238 - DNA, 20 bp, Artificial Sequence
  Description of Artificial Sequence: Synthetic oligonucleotide
  Target: FXN; (-) strand; PAM type: YTN; PAM sequence: CTG
ccatgagctttgattgtacc

SEQ ID NO: 29239 - DNA, 20 bp, Artificial Sequence
  Description of Artificial Sequence: Synthetic oligonucleotide
  Target: FXN; (-) strand; PAM type: YTN; PAM sequence: TTG
cccaagcccagggaggtcga

SEQ ID NO: 29240 - DNA, 20 bp, Artificial Sequence
  Description of Artificial Sequence: Synthetic oligonucleotide
  Target: FXN; (-) strand; PAM type: YTN; PAM sequence: CTG
tgggaggattgcccaagccc

SEQ ID NO: 29241 - DNA, 20 bp, Artificial Sequence
  Description of Artificial Sequence: Synthetic oligonucleotide
  Target: FXN; (-) strand; PAM type: YTN; PAM sequence: CTA
tggaggtgcacacctgtggg

SEQ ID NO: 29242 - DNA, 20 bp, Artificial Sequence
  Description of Artificial Sequence: Synthetic oligonucleotide
  Target: FXN; (-) strand; PAM type: YTN; PAM sequence: TTA
gccagctatggaggtgcaca

SEQ ID NO: 29243 - DNA, 20 bp, Artificial Sequence
  Description of Artificial Sequence: Synthetic oligonucleotide
  Target: FXN; (-) strand; PAM type: YTN; PAM sequence: CTA
caaaaaatacacaaattagc

SEQ ID NO: 29244 - DNA, 20 bp, Artificial Sequence
  Description of Artificial Sequence: Synthetic oligonucleotide
  Target: FXN; (-) strand; PAM type: YTN; PAM sequence: CTC
tacaaaaaatacacaaatta

SEQ ID NO: 29245 - DNA, 20 bp, Artificial Sequence
  Description of Artificial Sequence: Synthetic oligonucleotide
  Target: FXN; (-) strand; PAM type: YTN; PAM sequence: CTG
ggcaacatggtgaaacccca

SEQ ID NO: 29246 - DNA, 20 bp, Artificial Sequence
  Description of Artificial Sequence: Synthetic oligonucleotide
  Target: FXN; (-) strand; PAM type: YTN; PAM sequence: TTA
gagaccagcctgggcaacat

SEQ ID NO: 29247 - DNA, 20 bp, Artificial Sequence
  Description of Artificial Sequence: Synthetic oligonucleotide
  Target: FXN; (-) strand; PAM type: YTN; PAM sequence: CTA
agtgttagagaccagcctgg

SEQ ID NO: 29248 - DNA, 20 bp, Artificial Sequence
  Description of Artificial Sequence: Synthetic oligonucleotide
  Target: FXN; (-) strand; PAM type: YTN; PAM sequence: TTG
agcctaagtgttagagacca

SEQ ID NO: 29249 - DNA, 20 bp, Artificial Sequence
  Description of Artificial Sequence: Synthetic oligonucleotide
  Target: FXN; (-) strand; PAM type: YTN; PAM sequence: CTT
gagcctaagtgttagagacc

SEQ ID NO: 29250 - DNA, 20 bp, Artificial Sequence
  Description of Artificial Sequence: Synthetic oligonucleotide
  Target: FXN; (-) strand; PAM type: YTN; PAM sequence: TTG
ggaggacgaggcaggtggat

SEQ ID NO: 29251 - DNA, 20 bp, Artificial Sequence
  Description of Artificial Sequence: Synthetic oligonucleotide
  Target: FXN; (-) strand; PAM type: YTN; PAM sequence: CTT
gggaggacgaggcaggtgga

SEQ ID NO: 29252 - DNA, 20 bp, Artificial Sequence
  Description of Artificial Sequence: Synthetic oligonucleotide
  Target: FXN; (-) strand; PAM type: YTN; PAM sequence: CTG
taatcccagcatcttgggag

SEQ ID NO: 29253 - DNA, 20 bp, Artificial Sequence
  Description of Artificial Sequence: Synthetic oligonucleotide
  Target: FXN; (-) strand; PAM type: YTN; PAM sequence: CTG
tggcacacacctgtaatccc

SEQ ID NO: 29254 - DNA, 20 bp, Artificial Sequence
  Description of Artificial Sequence: Synthetic oligonucleotide
  Target: FXN; (-) strand; PAM type: YTN; PAM sequence: CTG
atgaacacctgtggcacaca

SEQ ID NO: 29255 - DNA, 20 bp, Artificial Sequence
  Description of Artificial Sequence: Synthetic oligonucleotide
  Target: FXN; (-) strand; PAM type: YTN; PAM sequence: TTC
tgatgaacacctgtggcaca

SEQ ID NO: 29256 - DNA, 20 bp, Artificial Sequence
  Description of Artificial Sequence: Synthetic oligonucleotide
  Target: FXN; (-) strand; PAM type: YTN; PAM sequence: TTT
ctgatgaacacctgtggcac

SEQ ID NO: 29257 - DNA, 20 bp, Artificial Sequence
  Description of Artificial Sequence: Synthetic oligonucleotide
  Target: FXN; (-) strand; PAM type: YTN; PAM sequence: CTT
tctgatgaacacctgtggca

SEQ ID NO: 29258 - DNA, 20 bp, Artificial Sequence
  Description of Artificial Sequence: Synthetic oligonucleotide
  Target: FXN; (-) strand; PAM type: YTN; PAM sequence: CTC
aagaaggtaaaaataataga

SEQ ID NO: 29259 - DNA, 20 bp, Artificial Sequence
  Description of Artificial Sequence: Synthetic oligonucleotide
  Target: FXN; (-) strand; PAM type: YTN; PAM sequence: CTA
cccactcaagaaggtaaaaa

SEQ ID NO: 29260 - DNA, 20 bp, Artificial Sequence
  Description of Artificial Sequence: Synthetic oligonucleotide
  Target: FXN; (-) strand; PAM type: YTN; PAM sequence: TTC
tacccactcaagaaggtaaa

SEQ ID NO: 29261 - DNA, 20 bp, Artificial Sequence
  Description of Artificial Sequence: Synthetic oligonucleotide
  Target: FXN; (-) strand; PAM type: YTN; PAM sequence: CTG
aggttctacccactcaagaa

SEQ ID NO: 29262 - DNA, 20 bp, Artificial Sequence
  Description of Artificial Sequence: Synthetic oligonucleotide
  Target: FXN; (-) strand; PAM type: YTN; PAM sequence: CTA
tgtggctgaggttctaccca

SEQ ID NO: 29263 - DNA, 20 bp, Artificial Sequence
  Description of Artificial Sequence: Synthetic oligonucleotide
  Target: FXN; (-) strand; PAM type: YTN; PAM sequence: TTC
tatgtggctgaggttctacc

SEQ ID NO: 29264 - DNA, 20 bp, Artificial Sequence
  Description of Artificial Sequence: Synthetic oligonucleotide
  Target: FXN; (-) strand; PAM type: YTN; PAM sequence: TTT
ctatgtggctgaggttctac

SEQ ID NO: 29265 - DNA, 20 bp, Artificial Sequence
  Description of Artificial Sequence: Synthetic oligonucleotide
  Target: FXN; (-) strand; PAM type: YTN; PAM sequence: TTT
tctatgtggctgaggttcta

SEQ ID NO: 29266 - DNA, 20 bp, Artificial Sequence
  Description of Artificial Sequence: Synthetic oligonucleotide
  Target: FXN; (-) strand; PAM type: YTN; PAM sequence: TTA
ttttctatgtggctgaggtt

SEQ ID NO: 29267 - DNA, 20 bp, Artificial Sequence
  Description of Artificial Sequence: Synthetic oligonucleotide
  Target: FXN; (-) strand; PAM type: YTN; PAM sequence: TTT
attttctatgtggctgaggt

SEQ ID NO: 29268 - DNA, 20 bp, Artificial Sequence
  Description of Artificial Sequence: Synthetic oligonucleotide
  Target: FXN; (-) strand; PAM type: YTN; PAM sequence: TTT
tattttctatgtggctgagg

SEQ ID NO: 29269 - DNA, 20 bp, Artificial Sequence
  Description of Artificial Sequence: Synthetic oligonucleotide
  Target: FXN; (-) strand; PAM type: YTN; PAM sequence: CTA
aataagtcatgccagaacat

SEQ ID NO: 29270 - DNA, 20 bp, Artificial Sequence
  Description of Artificial Sequence: Synthetic oligonucleotide
  Target: FXN; (-) strand; PAM type: YTN; PAM sequence: TTC
cagagagctaaataagtcat

SEQ ID NO: 29271 - DNA, 20 bp, Artificial Sequence
  Description of Artificial Sequence: Synthetic oligonucleotide
  Target: FXN; (-) strand; PAM type: YTN; PAM sequence: TTG
taattccagagagctaaata

SEQ ID NO: 29272 - DNA, 20 bp, Artificial Sequence
  Description of Artificial Sequence: Synthetic oligonucleotide
  Target: FXN; (-) strand; PAM type: YTN; PAM sequence: TTT
gtaattccagagagctaaat

SEQ ID NO: 29273 - DNA, 20 bp, Artificial Sequence
  Description of Artificial Sequence: Synthetic oligonucleotide
  Target: FXN; (-) strand; PAM type: YTN; PAM sequence: CTT
tgtaattccagagagctaaa

SEQ ID NO: 29274 - DNA, 20 bp, Artificial Sequence
  Description of Artificial Sequence: Synthetic oligonucleotide
  Target: FXN; (-) strand; PAM type: YTN; PAM sequence: TTC
tttgtaattccagagagcta

SEQ ID NO: 29275 - DNA, 20 bp, Artificial Sequence
  Description of Artificial Sequence: Synthetic oligonucleotide
  Target: FXN; (-) strand; PAM type: YTN; PAM sequence: CTT
ctttgtaattccagagagct

SEQ ID NO: 29276 - DNA, 20 bp, Artificial Sequence
  Description of Artificial Sequence: Synthetic oligonucleotide
  Target: FXN; (-) strand; PAM type: YTN; PAM sequence: TTC
cttctttgtaattccagaga

SEQ ID NO: 29277 - DNA, 20 bp, Artificial Sequence
  Description of Artificial Sequence: Synthetic oligonucleotide
  Target: FXN; (-) strand; PAM type: YTN; PAM sequence: CTC
attccttctttgtaattcca

SEQ ID NO: 29278 - DNA, 20 bp, Artificial Sequence
  Description of Artificial Sequence: Synthetic oligonucleotide
  Target: FXN; (-) strand; PAM type: YTN; PAM sequence: TTA
cacacctcattccttctttg

SEQ ID NO: 29279 - DNA, 20 bp, Artificial Sequence
  Description of Artificial Sequence: Synthetic oligonucleotide
  Target: FXN; (-) strand; PAM type: YTN; PAM sequence: TTT
acacacctcattccttcttt

SEQ ID NO: 29280 - DNA, 20 bp, Artificial Sequence
  Description of Artificial Sequence: Synthetic oligonucleotide
  Target: FXN; (-) strand; PAM type: YTN; PAM sequence: TTT
tacacacctcattccttctt

SEQ ID NO: 29281 - DNA, 20 bp, Artificial Sequence
  Description of Artificial Sequence: Synthetic oligonucleotide
  Target: FXN; (-) strand; PAM type: YTN; PAM sequence: CTT
ttacacacctcattccttct

SEQ ID NO: 29282 - DNA, 20 bp, Artificial Sequence
  Description of Artificial Sequence: Synthetic oligonucleotide
  Target: FXN; (-) strand; PAM type: YTN; PAM sequence: CTC
ttttacacacctcattcctt

SEQ ID NO: 29283 - DNA, 20 bp, Artificial Sequence
  Description of Artificial Sequence: Synthetic oligonucleotide
  Target: FXN; (-) strand; PAM type: YTN; PAM sequence: TTC
tcttttacacacctcattcc

SEQ ID NO: 29284 - DNA, 20 bp, Artificial Sequence
  Description of Artificial Sequence: Synthetic oligonucleotide
  Target: FXN; (-) strand; PAM type: YTN; PAM sequence: TTC
aaaaacccaggttctctttt

SEQ ID NO: 29285 - DNA, 20 bp, Artificial Sequence
  Description of Artificial Sequence: Synthetic oligonucleotide
  Target: FXN; (-) strand; PAM type: YTN; PAM sequence: TTG
tgattcaaaaacccaggttc

SEQ ID NO: 29286 - DNA, 20 bp, Artificial Sequence
  Description of Artificial Sequence: Synthetic oligonucleotide
  Target: FXN; (-) strand; PAM type: YTN; PAM sequence: TTT
gtgattcaaaaacccaggtt

SEQ ID NO: 29287 - DNA, 20 bp, Artificial Sequence
  Description of Artificial Sequence: Synthetic oligonucleotide
  Target: FXN; (-) strand; PAM type: YTN; PAM sequence: CTA
aatttgtgattcaaaaaccc

SEQ ID NO: 29288 - DNA, 20 bp, Artificial Sequence
  Description of Artificial Sequence: Synthetic oligonucleotide
  Target: FXN; (-) strand; PAM type: YTN; PAM sequence: TTC
taaatttgtgattcaaaaac

SEQ ID NO: 29289 - DNA, 20 bp, Artificial Sequence
  Description of Artificial Sequence: Synthetic oligonucleotide
  Target: FXN; (-) strand; PAM type: YTN; PAM sequence: TTA
aattctaaatttgtgattca

SEQ ID NO: 29290 - DNA, 20 bp, Artificial Sequence
  Description of Artificial Sequence: Synthetic oligonucleotide
  Target: FXN; (-) strand; PAM type: YTN; PAM sequence: TTC
gattaaattctaaatttgtg

SEQ ID NO: 29291 - DNA, 20 bp, Artificial Sequence
  Description of Artificial Sequence: Synthetic oligonucleotide
  Target: FXN; (-) strand; PAM type: YTN; PAM sequence: TTT
cgattaaattctaaatttgt

SEQ ID NO: 29292 - DNA, 20 bp, Artificial Sequence
  Description of Artificial Sequence: Synthetic oligonucleotide
  Target: FXN; (-) strand; PAM type: YTN; PAM sequence: CTA
caaacaagtaagaggcagag

SEQ ID NO: 29293 - DNA, 20 bp, Artificial Sequence
  Description of Artificial Sequence: Synthetic oligonucleotide
  Target: FXN; (-) strand; PAM type: YTN; PAM sequence: CTG
tcagtgtctacaaacaagta

SEQ ID NO: 29294 - DNA, 20 bp, Artificial Sequence
  Description of Artificial Sequence: Synthetic oligonucleotide
  Target: FXN; (-) strand; PAM type: YTN; PAM sequence: TTA
aaaaaaaaaaaaacatgagg

SEQ ID NO: 29295 - DNA, 20 bp, Artificial Sequence
  Description of Artificial Sequence: Synthetic oligonucleotide
  Target: FXN; (-) strand; PAM type: YTN; PAM sequence: TTA
tagattaaaaaaaaaaaaaa

SEQ ID NO: 29296 - DNA, 20 bp, Artificial Sequence
  Description of Artificial Sequence: Synthetic oligonucleotide
  Target: FXN; (-) strand; PAM type: YTN; PAM sequence: TTT
atagattaaaaaaaaaaaaa

SEQ ID NO: 29297 - DNA, 20 bp, Artificial Sequence
  Description of Artificial Sequence: Synthetic oligonucleotide
  Target: FXN; (-) strand; PAM type: YTN; PAM sequence: TTT
tatagattaaaaaaaaaaaa

SEQ ID NO: 29298 - DNA, 20 bp, Artificial Sequence
  Description of Artificial Sequence: Synthetic oligonucleotide
  Target: FXN; (-) strand; PAM type: YTN; PAM sequence: CTC
cattttatagattaaaaaaa

SEQ ID NO: 29299 - DNA, 20 bp, Artificial Sequence
  Description of Artificial Sequence: Synthetic oligonucleotide
  Target: FXN; (-) strand; PAM type: YTN; PAM sequence: TTA
gatatctccattttatagat

SEQ ID NO: 29300 - DNA, 20 bp, Artificial Sequence
  Description of Artificial Sequence: Synthetic oligonucleotide
  Target: FXN; (-) strand; PAM type: YTN; PAM sequence: CTC
aacatgttagatatctccat

SEQ ID NO: 29301 - DNA, 20 bp, Artificial Sequence
  Description of Artificial Sequence: Synthetic oligonucleotide
  Target: FXN; (-) strand; PAM type: YTN; PAM sequence: CTG
tgggcccaggctcaacatgt

SEQ ID NO: 29302 - DNA, 20 bp, Artificial Sequence
  Description of Artificial Sequence: Synthetic oligonucleotide
  Target: FXN; (-) strand; PAM type: YTN; PAM sequence: TTG
cctgtgggcccaggctcaac

SEQ ID NO: 29303 - DNA, 20 bp, Artificial Sequence
  Description of Artificial Sequence: Synthetic oligonucleotide
  Target: FXN; (-) strand; PAM type: YTN; PAM sequence: TTT
gcctgtgggcccaggctcaa

SEQ ID NO: 29304 - DNA, 20 bp, Artificial Sequence
  Description of Artificial Sequence: Synthetic oligonucleotide
  Target: FXN; (-) strand; PAM type: YTN; PAM sequence: CTT
tgcctgtgggcccaggctca

SEQ ID NO: 29305 - DNA, 20 bp, Artificial Sequence
  Description of Artificial Sequence: Synthetic oligonucleotide
  Target: FXN; (-) strand; PAM type: YTN; PAM sequence: TTG
tgctttgcctgtgggcccag

SEQ ID NO: 29306 - DNA, 20 bp, Artificial Sequence
  Description of Artificial Sequence: Synthetic oligonucleotide
  Target: FXN; (-) strand; PAM type: YTN; PAM sequence: CTC
acatcaggattgtgctttgc

SEQ ID NO: 29307 - DNA, 20 bp, Artificial Sequence
  Description of Artificial Sequence: Synthetic oligonucleotide
  Target: FXN; (-) strand; PAM type: YTN; PAM sequence: TTC
tcacatcaggattgtgcttt

SEQ ID NO: 29308 - DNA, 20 bp, Artificial Sequence
  Description of Artificial Sequence: Synthetic oligonucleotide
  Target: FXN; (-) strand; PAM type: YTN; PAM sequence: CTT
ctcacatcaggattgtgctt

SEQ ID NO: 29309 - DNA, 20 bp, Artificial Sequence
  Description of Artificial Sequence: Synthetic oligonucleotide
  Target: FXN; (-) strand; PAM type: YTN; PAM sequence: CTG
agtacttctcacatcaggat

SEQ ID NO: 29310 - DNA, 20 bp, Artificial Sequence
  Description of Artificial Sequence: Synthetic oligonucleotide
  Target: FXN; (-) strand; PAM type: YTN; PAM sequence: TTG
tcatgaactgagtacttctc

SEQ ID NO: 29311 - DNA, 20 bp, Artificial Sequence
  Description of Artificial Sequence: Synthetic oligonucleotide
  Target: FXN; (-) strand; PAM type: YTN; PAM sequence: CTA
tgcatgtgagaacaacagtt

SEQ ID NO: 29312 - DNA, 20 bp, Artificial Sequence
  Description of Artificial Sequence: Synthetic oligonucleotide
  Target: FXN; (-) strand; PAM type: YTN; PAM sequence: TTA
tgctatgcatgtgagaacaa

SEQ ID NO: 29313 - DNA, 20 bp, Artificial Sequence
  Description of Artificial Sequence: Synthetic oligonucleotide
  Target: FXN; (-) strand; PAM type: YTN; PAM sequence: CTC
caatgtgaatatgaaattat

SEQ ID NO: 29314 - DNA, 20 bp, Artificial Sequence
  Description of Artificial Sequence: Synthetic oligonucleotide
  Target: FXN; (-) strand; PAM type: YTN; PAM sequence: TTG
ggagaagtcctccaatgtga

SEQ ID NO: 29315 - DNA, 20 bp, Artificial Sequence
  Description of Artificial Sequence: Synthetic oligonucleotide
  Target: FXN; (-) strand; PAM type: YTN; PAM sequence: TTT
gggagaagtcctccaatgtg

SEQ ID NO: 29316 - DNA, 20 bp, Artificial Sequence
  Description of Artificial Sequence: Synthetic oligonucleotide
  Target: FXN; (-) strand; PAM type: YTN; PAM sequence: TTT
tgggagaagtcctccaatgt

SEQ ID NO: 29317 - DNA, 20 bp, Artificial Sequence
  Description of Artificial Sequence: Synthetic oligonucleotide
  Target: FXN; (-) strand; PAM type: YTN; PAM sequence: TTG
agtagggaacgtcatccata

SEQ ID NO: 29318 - DNA, 20 bp, Artificial Sequence
  Description of Artificial Sequence: Synthetic oligonucleotide
  Target: FXN; (-) strand; PAM type: YTN; PAM sequence: TTC
aaggttgagtagggaacgtc

SEQ ID NO: 29319 - DNA, 20 bp, Artificial Sequence
  Description of Artificial Sequence: Synthetic oligonucleotide
  Target: FXN; (-) strand; PAM type: YTN; PAM sequence: TTA
agttcaaggttgagtaggga

SEQ ID NO: 29320 - DNA, 20 bp, Artificial Sequence
  Description of Artificial Sequence: Synthetic oligonucleotide
  Target: FXN; (-) strand; PAM type: YTN; PAM sequence: TTG
attaagttcaaggttgagta

SEQ ID NO: 29321 - DNA, 20 bp, Artificial Sequence
  Description of Artificial Sequence: Synthetic oligonucleotide
  Target: FXN; (-) strand; PAM type: YTN; PAM sequence: TTT
gattaagttcaaggttgagt

SEQ ID NO: 29322 - DNA, 20 bp, Artificial Sequence
  Description of Artificial Sequence: Synthetic oligonucleotide
  Target: FXN; (-) strand; PAM type: YTN; PAM sequence: TTT
tgattaagttcaaggttgag

SEQ ID NO: 29323 - DNA, 20 bp, Artificial Sequence
  Description of Artificial Sequence: Synthetic oligonucleotide
  Target: FXN; (-) strand; PAM type: YTN; PAM sequence: CTG
agtattttgattaagttcaa

SEQ ID NO: 29324 - DNA, 20 bp, Artificial Sequence
  Description of Artificial Sequence: Synthetic oligonucleotide
  Target: FXN; (-) strand; PAM type: YTN; PAM sequence: TTA
agtaaactgagtattttgat

SEQ ID NO: 29325 - DNA, 20 bp, Artificial Sequence
  Description of Artificial Sequence: Synthetic oligonucleotide
  Target: FXN; (-) strand; PAM type: YTN; PAM sequence: CTA
atacgaagttaagtaaactg

SEQ ID NO: 29326 - DNA, 20 bp, Artificial Sequence
  Description of Artificial Sequence: Synthetic oligonucleotide
  Target: FXN; (-) strand; PAM type: YTN; PAM sequence: TTC
cagggaatcagaatctaata

SEQ ID NO: 29327 - DNA, 20 bp, Artificial Sequence
  Description of Artificial Sequence: Synthetic oligonucleotide
  Target: FXN; (-) strand; PAM type: YTN; PAM sequence: TTA
gaaggtatgcaaaagatcaa

SEQ ID NO: 29328 - DNA, 20 bp, Artificial Sequence
  Description of Artificial Sequence: Synthetic oligonucleotide
  Target: FXN; (-) strand; PAM type: YTN; PAM sequence: TTT
agaaggtatgcaaaagatca

SEQ ID NO: 29329 - DNA, 20 bp, Artificial Sequence
  Description of Artificial Sequence: Synthetic oligonucleotide
  Target: FXN; (-) strand; PAM type: YTN; PAM sequence: TTT
tagaaggtatgcaaaagatc

SEQ ID NO: 29330 - DNA, 20 bp, Artificial Sequence
  Description of Artificial Sequence: Synthetic oligonucleotide
  Target: FXN; (-) strand; PAM type: YTN; PAM sequence: CTA
aaatagttttagaaggtatg

SEQ ID NO: 29331 - DNA, 20 bp, Artificial Sequence
  Description of Artificial Sequence: Synthetic oligonucleotide
  Target: FXN; (-) strand; PAM type: YTN; PAM sequence: TTG
gctaaaatagttttagaagg

SEQ ID NO: 29332 - DNA, 20 bp, Artificial Sequence
  Description of Artificial Sequence: Synthetic oligonucleotide
  Target: FXN; (-) strand; PAM type: YTN; PAM sequence: TTA
aattggctaaaatagtttta

SEQ ID NO: 29333 - DNA, 20 bp, Artificial Sequence
  Description of Artificial Sequence: Synthetic oligonucleotide
  Target: FXN; (-) strand; PAM type: YTN; PAM sequence: TTT
aaattggctaaaatagtttt

SEQ ID NO: 29334 - DNA, 20 bp, Artificial Sequence
  Description of Artificial Sequence: Synthetic oligonucleotide
  Target: FXN; (-) strand; PAM type: YTN; PAM sequence: TTT
taaattggctaaaatagttt

SEQ ID NO: 29335 - DNA, 20 bp, Artificial Sequence
  Description of Artificial Sequence: Synthetic oligonucleotide
  Target: FXN; (-) strand; PAM type: YTN; PAM sequence: CTG
tcaaattttaaattggctaa

SEQ ID NO: 29336 - DNA, 20 bp, Artificial Sequence
  Description of Artificial Sequence: Synthetic oligonucleotide
  Target: FXN; (-) strand; PAM type: YTN; PAM sequence: TTA
atgcaaactgtcaaatttta

SEQ ID NO: 29337 - DNA, 20 bp, Artificial Sequence
  Description of Artificial Sequence: Synthetic oligonucleotide
  Target: FXN; (-) strand; PAM type: YTN; PAM sequence: TTT
aatgcaaactgtcaaatttt

SEQ ID NO: 29338 - DNA, 20 bp, Artificial Sequence
  Description of Artificial Sequence: Synthetic oligonucleotide
  Target: FXN; (-) strand; PAM type: YTN; PAM sequence: CTA
taatttaatgcaaactgtca

SEQ ID NO: 29339 - DNA, 20 bp, Artificial Sequence
  Description of Artificial Sequence: Synthetic oligonucleotide
  Target: FXN; (-) strand; PAM type: YTN; PAM sequence: TTG
taaacctataatttaatgca

SEQ ID NO: 29340 - DNA, 20 bp, Artificial Sequence
  Description of Artificial Sequence: Synthetic oligonucleotide
  Target: FXN; (-) strand; PAM type: YTN; PAM sequence: CTG
gataaagcatattgtaaacc

SEQ ID NO: 29341 - DNA, 20 bp, Artificial Sequence
  Description of Artificial Sequence: Synthetic oligonucleotide
  Target: FXN; (-) strand; PAM type: YTN; PAM sequence: TTG
gggcaggtatagctggataa

SEQ ID NO: 29342 - DNA, 20 bp, Artificial Sequence
  Description of Artificial Sequence: Synthetic oligonucleotide
  Target: FXN; (-) strand; PAM type: YTN; PAM sequence: TTT
ggggcaggtatagctggata

SEQ ID NO: 29343 - DNA, 20 bp, Artificial Sequence
  Description of Artificial Sequence: Synthetic oligonucleotide
  Target: FXN; (-) strand; PAM type: YTN; PAM sequence: CTG
tcagaatttggggcaggtat

SEQ ID NO: 29344 - DNA, 20 bp, Artificial Sequence
  Description of Artificial Sequence: Synthetic oligonucleotide
  Target: FXN; (-) strand; PAM type: YTN; PAM sequence: TTA
gaggtggcaaaagcatctgt

SEQ ID NO: 29345 - DNA, 20 bp, Artificial Sequence
  Description of Artificial Sequence: Synthetic oligonucleotide
  Target: FXN; (-) strand; PAM type: YTN; PAM sequence: TTT
agaggtggcaaaagcatctg

SEQ ID NO: 29346 - DNA, 20 bp, Artificial Sequence
  Description of Artificial Sequence: Synthetic oligonucleotide
  Target: FXN; (-) strand; PAM type: YTN; PAM sequence: CTT
tagaggtggcaaaagcatct

SEQ ID NO: 29347 - DNA, 20 bp, Artificial Sequence
  Description of Artificial Sequence: Synthetic oligonucleotide
  Target: FXN; (-) strand; PAM type: YTN; PAM sequence: TTC
ctttagaggtggcaaaagca

SEQ ID NO: 29348 - DNA, 20 bp, Artificial Sequence
  Description of Artificial Sequence: Synthetic oligonucleotide
  Target: FXN; (-) strand; PAM type: YTN; PAM sequence: CTT
cctttagaggtggcaaaagc

SEQ ID NO: 29349 - DNA, 20 bp, Artificial Sequence
  Description of Artificial Sequence: Synthetic oligonucleotide
  Target: FXN; (-) strand; PAM type: YTN; PAM sequence: CTA
tgaacatgggtcttccttta

SEQ ID NO: 29350 - DNA, 20 bp, Artificial Sequence
  Description of Artificial Sequence: Synthetic oligonucleotide
  Target: FXN; (-) strand; PAM type: YTN; PAM sequence: CTC
catcactatgaacatgggtc

SEQ ID NO: 29351 - DNA, 20 bp, Artificial Sequence
  Description of Artificial Sequence: Synthetic oligonucleotide
  Target: FXN; (-) strand; PAM type: YTN; PAM sequence: TTA
gtccacacaaactccatcac

SEQ ID NO: 29352 - DNA, 20 bp, Artificial Sequence
  Description of Artificial Sequence: Synthetic oligonucleotide
  Target: FXN; (-) strand; PAM type: YTN; PAM sequence: TTG
catggttagtccacacaaac

SEQ ID NO: 29353 - DNA, 20 bp, Artificial Sequence
  Description of Artificial Sequence: Synthetic oligonucleotide
  Target: FXN; (-) strand; PAM type: YTN; PAM sequence: CTT
gcatggttagtccacacaaa

SEQ ID NO: 29354 - DNA, 20 bp, Artificial Sequence
  Description of Artificial Sequence: Synthetic oligonucleotide
  Target: FXN; (-) strand; PAM type: YTN; PAM sequence: TTG
gcaaccttgcatggttagtc

SEQ ID NO: 29355 - DNA, 20 bp, Artificial Sequence
  Description of Artificial Sequence: Synthetic oligonucleotide
  Target: FXN; (-) strand; PAM type: YTN; PAM sequence: CTT
ggcaaccttgcatggttagt

SEQ ID NO: 29356 - DNA, 20 bp, Artificial Sequence
  Description of Artificial Sequence: Synthetic oligonucleotide
  Target: FXN; (-) strand; PAM type: YTN; PAM sequence: TTC
cttggcaaccttgcatggtt

SEQ ID NO: 29357 - DNA, 20 bp, Artificial Sequence
  Description of Artificial Sequence: Synthetic oligonucleotide
  Target: FXN; (-) strand; PAM type: YTN; PAM sequence: TTT
ccttggcaaccttgcatggt

SEQ ID NO: 29358 - DNA, 20 bp, Artificial Sequence
  Description of Artificial Sequence: Synthetic oligonucleotide
  Target: FXN; (-) strand; PAM type: YTN; PAM sequence: TTT
tccttggcaaccttgcatgg

SEQ ID NO: 29359 - DNA, 20 bp, Artificial Sequence
  Description of Artificial Sequence: Synthetic oligonucleotide
  Target: FXN; (-) strand; PAM type: YTN; PAM sequence: TTT
ttccttggcaaccttgcatg

SEQ ID NO: 29360 - DNA, 20 bp, Artificial Sequence
  Description of Artificial Sequence: Synthetic oligonucleotide
  Target: FXN; (-) strand; PAM type: YTN; PAM sequence: TTG
gaagcgtaaagcgatttttc

SEQ ID NO: 29361 - DNA, 20 bp, Artificial Sequence
  Description of Artificial Sequence: Synthetic oligonucleotide
  Target: FXN; (-) strand; PAM type: YTN; PAM sequence: CTT
ggaagcgtaaagcgattttt

SEQ ID NO: 29362 - DNA, 20 bp, Artificial Sequence
  Description of Artificial Sequence: Synthetic oligonucleotide
  Target: FXN; (-) strand; PAM type: YTN; PAM sequence: TTA
gtgtgtaccttggaagcgta

SEQ ID NO: 29363 - DNA, 20 bp, Artificial Sequence
  Description of Artificial Sequence: Synthetic oligonucleotide
  Target: FXN; (-) strand; PAM type: YTN; PAM sequence: CTT
agtgtgtaccttggaagcgt

SEQ ID NO: 29364 - DNA, 20 bp, Artificial Sequence
  Description of Artificial Sequence: Synthetic oligonucleotide
  Target: FXN; (-) strand; PAM type: YTN; PAM sequence: TTC
atcttagtgtgtaccttgga

SEQ ID NO: 29365 - DNA, 20 bp, Artificial Sequence
  Description of Artificial Sequence: Synthetic oligonucleotide
  Target: FXN; (-) strand; PAM type: YTN; PAM sequence: TTT
catcttagtgtgtaccttgg

SEQ ID NO: 29366 - DNA, 20 bp, Artificial Sequence
  Description of Artificial Sequence: Synthetic oligonucleotide
  Target: FXN; (-) strand; PAM type: YTN; PAM sequence: CTT
tcatcttagtgtgtaccttg

SEQ ID NO: 29367 - DNA, 20 bp, Artificial Sequence
  Description of Artificial Sequence: Synthetic oligonucleotide
  Target: FXN; (-) strand; PAM type: YTN; PAM sequence: TTA
ctttcatcttagtgtgtacc

SEQ ID NO: 29368 - DNA, 20 bp, Artificial Sequence
  Description of Artificial Sequence: Synthetic oligonucleotide
  Target: FXN; (-) strand; PAM type: YTN; PAM sequence: CTA
aaattactttcatcttagtg

SEQ ID NO: 29369 - DNA, 20 bp, Artificial Sequence
  Description of Artificial Sequence: Synthetic oligonucleotide
  Target: FXN; (-) strand; PAM type: YTN; PAM sequence: CTG
gacacggactaaaattactt

SEQ ID NO: 29370 - DNA, 20 bp, Artificial Sequence
  Description of Artificial Sequence: Synthetic oligonucleotide
  Target: FXN; (-) strand; PAM type: YTN; PAM sequence: CTA
tgtgccaagaatccaactgg

SEQ ID NO: 29371 - DNA, 20 bp, Artificial Sequence
  Description of Artificial Sequence: Synthetic oligonucleotide
  Target: FXN; (-) strand; PAM type: YTN; PAM sequence: CTA
gcagaagataactatgtgcc

SEQ ID NO: 29372 - DNA, 20 bp, Artificial Sequence
  Description of Artificial Sequence: Synthetic oligonucleotide
  Target: FXN; (-) strand; PAM type: YTN; PAM sequence: TTC
tagcagaagataactatgtg

SEQ ID NO: 29373 - DNA, 20 bp, Artificial Sequence
  Description of Artificial Sequence: Synthetic oligonucleotide
  Target: FXN; (-) strand; PAM type: YTN; PAM sequence: TTG
ttctagcagaagataactat

SEQ ID NO: 29374 - DNA, 20 bp, Artificial Sequence
  Description of Artificial Sequence: Synthetic oligonucleotide
  Target: FXN; (-) strand; PAM type: YTN; PAM sequence: TTT
gttctagcagaagataacta

SEQ ID NO: 29375 - DNA, 20 bp, Artificial Sequence
  Description of Artificial Sequence: Synthetic oligonucleotide
  Target: FXN; (-) strand; PAM type: YTN; PAM sequence: TTA
gtttgttctagcagaagata

SEQ ID NO: 29376 - DNA, 20 bp, Artificial Sequence
  Description of Artificial Sequence: Synthetic oligonucleotide
  Target: FXN; (-) strand; PAM type: YTN; PAM sequence: TTT
agtttgttctagcagaagat

SEQ ID NO: 29377 - DNA, 20 bp, Artificial Sequence
  Description of Artificial Sequence: Synthetic oligonucleotide
  Target: FXN; (-) strand; PAM type: YTN; PAM sequence: TTT
tagtttgttctagcagaaga

SEQ ID NO: 29378 - DNA, 20 bp, Artificial Sequence
  Description of Artificial Sequence: Synthetic oligonucleotide
  Target: FXN; (-) strand; PAM type: YTN; PAM sequence: CTG
ttttagtttgttctagcaga

SEQ ID NO: 29379 - DNA, 20 bp, Artificial Sequence
  Description of Artificial Sequence: Synthetic oligonucleotide
  Target: FXN; (-) strand; PAM type: YTN; PAM sequence: CTG
gcatgtagctgttttagttt

SEQ ID NO: 29380 - DNA, 20 bp, Artificial Sequence
  Description of Artificial Sequence: Synthetic oligonucleotide
  Target: FXN; (-) strand; PAM type: YTN; PAM sequence: TTG
ctggcatgtagctgttttag

SEQ ID NO: 29381 - DNA, 20 bp, Artificial Sequence
  Description of Artificial Sequence: Synthetic oligonucleotide
  Target: FXN; (-) strand; PAM type: YTN; PAM sequence: CTT
gctggcatgtagctgtttta

SEQ ID NO: 29382 - DNA, 20 bp, Artificial Sequence
  Description of Artificial Sequence: Synthetic oligonucleotide
  Target: FXN; (-) strand; PAM type: YTN; PAM sequence: CTC
ccttgctggcatgtagctgt

SEQ ID NO: 29383 - DNA, 20 bp, Artificial Sequence
  Description of Artificial Sequence: Synthetic oligonucleotide
  Target: FXN; (-) strand; PAM type: YTN; PAM sequence: TTC
tcccttgctggcatgtagct

SEQ ID NO: 29384 - DNA, 20 bp, Artificial Sequence
  Description of Artificial Sequence: Synthetic oligonucleotide
  Target: FXN; (-) strand; PAM type: YTN; PAM sequence: TTT
ctcccttgctggcatgtagc

SEQ ID NO: 29385 - DNA, 20 bp, Artificial Sequence
  Description of Artificial Sequence: Synthetic oligonucleotide
  Target: FXN; (-) strand; PAM type: YTN; PAM sequence: CTT
tctcccttgctggcatgtag

SEQ ID NO: 29386 - DNA, 20 bp, Artificial Sequence
  Description of Artificial Sequence: Synthetic oligonucleotide
  Target: FXN; (-) strand; PAM type: YTN; PAM sequence: TTC
ccctttctcccttgctggca

SEQ ID NO: 29387 - DNA, 20 bp, Artificial Sequence
  Description of Artificial Sequence: Synthetic oligonucleotide
  Target: FXN; (-) strand; PAM type: YTN; PAM sequence: CTT
cccctttctcccttgctggc

SEQ ID NO: 29388 - DNA, 20 bp, Artificial Sequence
  Description of Artificial Sequence: Synthetic oligonucleotide
  Target: FXN; (-) strand; PAM type: YTN; PAM sequence: CTC
cttcccctttctcccttgct

SEQ ID NO: 29389 - DNA, 20 bp, Artificial Sequence
  Description of Artificial Sequence: Synthetic oligonucleotide
  Target: FXN; (-) strand; PAM type: YTN; PAM sequence: TTG
cccctccttcccctttctcc

SEQ ID NO: 29390 - DNA, 20 bp, Artificial Sequence
  Description of Artificial Sequence: Synthetic oligonucleotide
  Target: FXN; (-) strand; PAM type: YTN; PAM sequence: TTT
gcccctccttcccctttctc

SEQ ID NO: 29391 - DNA, 20 bp, Artificial Sequence
  Description of Artificial Sequence: Synthetic oligonucleotide
  Target: FXN; (-) strand; PAM type: YTN; PAM sequence: CTT
tgcccctccttcccctttct

SEQ ID NO: 29392 - DNA, 20 bp, Artificial Sequence
  Description of Artificial Sequence: Synthetic oligonucleotide
  Target: FXN; (-) strand; PAM type: YTN; PAM sequence: TTC
aaaactttgcccctccttcc

SEQ ID NO: 29393 - DNA, 20 bp, Artificial Sequence
  Description of Artificial Sequence: Synthetic oligonucleotide
  Target: FXN; (-) strand; PAM type: YTN; PAM sequence: TTT
caaaactttgcccctccttc

SEQ ID NO: 29394 - DNA, 20 bp, Artificial Sequence
  Description of Artificial Sequence: Synthetic oligonucleotide
  Target: FXN; (-) strand; PAM type: YTN; PAM sequence: TTA
catgaaatttcaaaactttg

SEQ ID NO: 29395 - DNA, 20 bp, Artificial Sequence
  Description of Artificial Sequence: Synthetic oligonucleotide
  Target: FXN; (-) strand; PAM type: YTN; PAM sequence: TTT
acatgaaatttcaaaacttt

SEQ ID NO: 29396 - DNA, 20 bp, Artificial Sequence
  Description of Artificial Sequence: Synthetic oligonucleotide
  Target: FXN; (-) strand; PAM type: YTN; PAM sequence: TTG
aacagcataaatttacatga

SEQ ID NO: 29397 - DNA, 20 bp, Artificial Sequence
  Description of Artificial Sequence: Synthetic oligonucleotide
  Target: FXN; (-) strand; PAM type: YTN; PAM sequence: TTT
gaacagcataaatttacatg

SEQ ID NO: 29398 - DNA, 20 bp, Artificial Sequence
  Description of Artificial Sequence: Synthetic oligonucleotide
  Target: FXN; (-) strand; PAM type: YTN; PAM sequence: TTT
tgaacagcataaatttacat

SEQ ID NO: 29399 - DNA, 20 bp, Artificial Sequence
  Description of Artificial Sequence: Synthetic oligonucleotide
  Target: FXN; (-) strand; PAM type: YTN; PAM sequence: CTC
gtcgttttgaacagcataaa

SEQ ID NO: 29400 - DNA, 20 bp, Artificial Sequence
  Description of Artificial Sequence: Synthetic oligonucleotide
  Target: FXN; (-) strand; PAM type: YTN; PAM sequence: CTA
tacacaaagtcatgaactcg

SEQ ID NO: 29401 - DNA, 20 bp, Artificial Sequence
  Description of Artificial Sequence: Synthetic oligonucleotide
  Target: FXN; (-) strand; PAM type: YTN; PAM sequence: CTC
tatacacaaagtcatgaact

SEQ ID NO: 29402 - DNA, 20 bp, Artificial Sequence
  Description of Artificial Sequence: Synthetic oligonucleotide
  Target: FXN; (-) strand; PAM type: YTN; PAM sequence: TTA
ctctatacacaaagtcatga

SEQ ID NO: 29403 - DNA, 20 bp, Artificial Sequence
  Description of Artificial Sequence: Synthetic oligonucleotide
  Target: FXN; (-) strand; PAM type: YTN; PAM sequence: CTT
actctatacacaaagtcatg

SEQ ID NO: 29404 - DNA, 20 bp, Artificial Sequence
  Description of Artificial Sequence: Synthetic oligonucleotide
  Target: FXN; (-) strand; PAM type: YTN; PAM sequence: TTC
ttactctatacacaaagtca

SEQ ID NO: 29405 - DNA, 20 bp, Artificial Sequence
  Description of Artificial Sequence: Synthetic oligonucleotide
  Target: FXN; (-) strand; PAM type: YTN; PAM sequence: TTT
cttactctatacacaaagtc

SEQ ID NO: 29406 - DNA, 20 bp, Artificial Sequence
  Description of Artificial Sequence: Synthetic oligonucleotide
  Target: FXN; (-) strand; PAM type: YTN; PAM sequence: CTC
aaaaaagaaaaggcatttct

SEQ ID NO: 29407 - DNA, 20 bp, Artificial Sequence
  Description of Artificial Sequence: Synthetic oligonucleotide
  Target: FXN; (-) strand; PAM type: YTN; PAM sequence: CTG
tctcaaaaaagaaaaggcat

SEQ ID NO: 29408 - DNA, 20 bp, Artificial Sequence
  Description of Artificial Sequence: Synthetic oligonucleotide
  Target: FXN; (-) strand; PAM type: YTN; PAM sequence: CTC
tgtctcaaaaaagaaaaggc

SEQ ID NO: 29409 - DNA, 20 bp, Artificial Sequence
  Description of Artificial Sequence: Synthetic oligonucleotide
  Target: FXN; (-) strand; PAM type: YTN; PAM sequence: CTG
ggtgacagagcaagactctg

SEQ ID NO: 29410 - DNA, 20 bp, Artificial Sequence
  Description of Artificial Sequence: Synthetic oligonucleotide
  Target: FXN; (-) strand; PAM type: YTN; PAM sequence: CTC
cagcctgggtgacagagcaa

SEQ ID NO: 29411 - DNA, 20 bp, Artificial Sequence
  Description of Artificial Sequence: Synthetic oligonucleotide
  Target: FXN; (-) strand; PAM type: YTN; PAM sequence: CTG
cactccagcctgggtgacag

SEQ ID NO: 29412 - DNA, 20 bp, Artificial Sequence
  Description of Artificial Sequence: Synthetic oligonucleotide
  Target: FXN; (-) strand; PAM type: YTN; PAM sequence: TTG
tagtgagcccagatcgtgcc

SEQ ID NO: 29413 - DNA, 20 bp, Artificial Sequence
  Description of Artificial Sequence: Synthetic oligonucleotide
  Target: FXN; (-) strand; PAM type: YTN; PAM sequence: TTG
aacccaggaggcggaggttg

SEQ ID NO: 29414 - DNA, 20 bp, Artificial Sequence
  Description of Artificial Sequence: Synthetic oligonucleotide
  Target: FXN; (-) strand; PAM type: YTN; PAM sequence: CTT
gaacccaggaggcggaggtt

SEQ ID NO: 29415 - DNA, 20 bp, Artificial Sequence
  Description of Artificial Sequence: Synthetic oligonucleotide
  Target: FXN; (-) strand; PAM type: YTN; PAM sequence: TTG
cttgaacccaggaggcggag

SEQ ID NO: 29416 - DNA, 20 bp, Artificial Sequence
  Description of Artificial Sequence: Synthetic oligonucleotide
  Target: FXN; (-) strand; PAM type: YTN; PAM sequence: CTG
aggcagagaattgcttgaac

SEQ ID NO: 29417 - DNA, 20 bp, Artificial Sequence
  Description of Artificial Sequence: Synthetic oligonucleotide
  Target: FXN; (-) strand; PAM type: YTN; PAM sequence: CTC
gggaggctgaggcagagaat

SEQ ID NO: 29418 - DNA, 20 bp, Artificial Sequence
  Description of Artificial Sequence: Synthetic oligonucleotide
  Target: FXN; (-) strand; PAM type: YTN; PAM sequence: CTA
ctcgggaggctgaggcagag

SEQ ID NO: 29419 - DNA, 20 bp, Artificial Sequence
  Description of Artificial Sequence: Synthetic oligonucleotide
  Target: FXN; (-) strand; PAM type: YTN; PAM sequence: CTG
taatcccagctactcgggag

SEQ ID NO: 29420 - DNA, 20 bp, Artificial Sequence
  Description of Artificial Sequence: Synthetic oligonucleotide
  Target: FXN; (-) strand; PAM type: YTN; PAM sequence: TTA
gccgggtgtggtggcaggca

SEQ ID NO: 29421 - DNA, 20 bp, Artificial Sequence
  Description of Artificial Sequence: Synthetic oligonucleotide
  Target: FXN; (-) strand; PAM type: YTN; PAM sequence: CTA
aaaatacaaaaattagccgg

SEQ ID NO: 29422 - DNA, 20 bp, Artificial Sequence
  Description of Artificial Sequence: Synthetic oligonucleotide
  Target: FXN; (-) strand; PAM type: YTN; PAM sequence: CTA
ctaaaaatacaaaaattagc

SEQ ID NO: 29423 - DNA, 20 bp, Artificial Sequence
  Description of Artificial Sequence: Synthetic oligonucleotide
  Target: FXN; (-) strand; PAM type: YTN; PAM sequence: CTC
tactaaaaatacaaaaatta

SEQ ID NO: 29424 - DNA, 20 bp, Artificial Sequence
  Description of Artificial Sequence: Synthetic oligonucleotide
  Target: FXN; (-) strand; PAM type: YTN; PAM sequence: CTG
gccatgatggtgaaaccccg

SEQ ID NO: 29425 - DNA, 20 bp, Artificial Sequence
  Description of Artificial Sequence: Synthetic oligonucleotide
  Target: FXN; (-) strand; PAM type: YTN; PAM sequence: TTC
aagaccagcctggccatgat

SEQ ID NO: 29426 - DNA, 20 bp, Artificial Sequence
  Description of Artificial Sequence: Synthetic oligonucleotide
  Target: FXN; (-) strand; PAM type: YTN; PAM sequence: CTA
ggtcaggagttcaagaccag

SEQ ID NO: 29427 - DNA, 20 bp, Artificial Sequence
  Description of Artificial Sequence: Synthetic oligonucleotide
  Target: FXN; (-) strand; PAM type: YTN; PAM sequence: TTA
ctaggtcaggagttcaagac

SEQ ID NO: 29428 - DNA, 20 bp, Artificial Sequence
  Description of Artificial Sequence: Synthetic oligonucleotide
  Target: FXN; (-) strand; PAM type: YTN; PAM sequence: TTG
ggaggcggaggcaggtggat

SEQ ID NO: 29429 - DNA, 20 bp, Artificial Sequence
  Description of Artificial Sequence: Synthetic oligonucleotide
  Target: FXN; (-) strand; PAM type: YTN; PAM sequence: TTT
gggaggcggaggcaggtgga

SEQ ID NO: 29430 - DNA, 20 bp, Artificial Sequence
  Description of Artificial Sequence: Synthetic oligonucleotide
  Target: FXN; (-) strand; PAM type: YTN; PAM sequence: CTT
tgggaggcggaggcaggtgg

SEQ ID NO: 29431 - DNA, 20 bp, Artificial Sequence
  Description of Artificial Sequence: Synthetic oligonucleotide
  Target: FXN; (-) strand; PAM type: YTN; PAM sequence: CTG
taatcccagcactttgggag

SEQ ID NO: 29432 - DNA, 20 bp, Artificial Sequence
  Description of Artificial Sequence: Synthetic oligonucleotide
  Target: FXN; (-) strand; PAM type: YTN; PAM sequence: CTC
acgcctgtaatcccagcact

SEQ ID NO: 29433 - DNA, 20 bp, Artificial Sequence
  Description of Artificial Sequence: Synthetic oligonucleotide
  Target: FXN; (-) strand; PAM type: YTN; PAM sequence: CTG
ggtgcagtggctcacgcctg

SEQ ID NO: 29434 - DNA, 20 bp, Artificial Sequence
  Description of Artificial Sequence: Synthetic oligonucleotide
  Target: FXN; (-) strand; PAM type: YTN; PAM sequence: CTG
gctgggtgcagtggctcacg

SEQ ID NO: 29435 - DNA, 20 bp, Artificial Sequence
  Description of Artificial Sequence: Synthetic oligonucleotide
  Target: FXN; (-) strand; PAM type: YTN; PAM sequence: TTC
tggctgggtgcagtggctca

SEQ ID NO: 29436 - DNA, 20 bp, Artificial Sequence
  Description of Artificial Sequence: Synthetic oligonucleotide
  Target: FXN; (-) strand; PAM type: YTN; PAM sequence: TTT
ctggctgggtgcagtggctc

SEQ ID NO: 29437 - DNA, 20 bp, Artificial Sequence
  Description of Artificial Sequence: Synthetic oligonucleotide
  Target: FXN; (-) strand; PAM type: YTN; PAM sequence: TTA
gaaggcatttctggctgggt

SEQ ID NO: 29438 - DNA, 20 bp, Artificial Sequence
  Description of Artificial Sequence: Synthetic oligonucleotide
  Target: FXN; (-) strand; PAM type: YTN; PAM sequence: TTA
agataaaccaaagattagaa

SEQ ID NO: 29439 - DNA, 20 bp, Artificial Sequence
  Description of Artificial Sequence: Synthetic oligonucleotide
  Target: FXN; (-) strand; PAM type: YTN; PAM sequence: CTA
attaagataaaccaaagatt

SEQ ID NO: 29440 - DNA, 20 bp, Artificial Sequence
  Description of Artificial Sequence: Synthetic oligonucleotide
  Target: FXN; (-) strand; PAM type: YTN; PAM sequence: CTG
gctaattaagataaaccaaa

SEQ ID NO: 29441 - DNA, 20 bp, Artificial Sequence
  Description of Artificial Sequence: Synthetic oligonucleotide
  Target: FXN; (-) strand; PAM type: YTN; PAM sequence: CTC
caagtgtcctggctaattaa

SEQ ID NO: 29442 - DNA, 20 bp, Artificial Sequence
  Description of Artificial Sequence: Synthetic oligonucleotide
  Target: FXN; (-) strand; PAM type: YTN; PAM sequence: TTC
gggatgcactccaagtgtcc

SEQ ID NO: 29443 - DNA, 20 bp, Artificial Sequence
  Description of Artificial Sequence: Synthetic oligonucleotide
  Target: FXN; (-) strand; PAM type: YTN; PAM sequence: CTT
cgggatgcactccaagtgtc

SEQ ID NO: 29444 - DNA, 20 bp, Artificial Sequence
  Description of Artificial Sequence: Synthetic oligonucleotide
  Target: FXN; (-) strand; PAM type: YTN; PAM sequence: CTG
atcaggtacttcgggatgca

SEQ ID NO: 29445 - DNA, 20 bp, Artificial Sequence
  Description of Artificial Sequence: Synthetic oligonucleotide
  Target: FXN; (-) strand; PAM type: YTN; PAM sequence: TTC
caaaggggccactgatcagg

SEQ ID NO: 29446 - DNA, 20 bp, Artificial Sequence
  Description of Artificial Sequence: Synthetic oligonucleotide
  Target: FXN; (-) strand; PAM type: YTN; PAM sequence: TTA
cacattccaaaggggccact

SEQ ID NO: 29447 - DNA, 20 bp, Artificial Sequence
  Description of Artificial Sequence: Synthetic oligonucleotide
  Target: FXN; (-) strand; PAM type: YTN; PAM sequence: TTT
acacattccaaaggggccac

SEQ ID NO: 29448 - DNA, 20 bp, Artificial Sequence
  Description of Artificial Sequence: Synthetic oligonucleotide
  Target: FXN; (-) strand; PAM type: YTN; PAM sequence: TTT
tacacattccaaaggggcca

SEQ ID NO: 29449 - DNA, 20 bp, Artificial Sequence
  Description of Artificial Sequence: Synthetic oligonucleotide
  Target: FXN; (-) strand; PAM type: YTN; PAM sequence: CTG
agttttacacattccaaagg

SEQ ID NO: 29450 - DNA, 20 bp, Artificial Sequence
  Description of Artificial Sequence: Synthetic oligonucleotide
  Target: FXN; (-) strand; PAM type: YTN; PAM sequence: CTG
tagcggatgcagggatataa

SEQ ID NO: 29451 - DNA, 20 bp, Artificial Sequence
  Description of Artificial Sequence: Synthetic oligonucleotide
  Target: FXN; (-) strand; PAM type: YTN; PAM sequence: CTC
tgtagcggatgcagggatat

SEQ ID NO: 29452 - DNA, 20 bp, Artificial Sequence
  Description of Artificial Sequence: Synthetic oligonucleotide
  Target: FXN; (-) strand; PAM type: YTN; PAM sequence: CTG
tctctgtagcggatgcaggg

SEQ ID NO: 29453 - DNA, 20 bp, Artificial Sequence
  Description of Artificial Sequence: Synthetic oligonucleotide
  Target: FXN; (-) strand; PAM type: YTN; PAM sequence: TTC
tgtctctgtagcggatgcag

SEQ ID NO: 29454 - DNA, 20 bp, Artificial Sequence
  Description of Artificial Sequence: Synthetic oligonucleotide
  Target: FXN; (-) strand; PAM type: YTN; PAM sequence: TTG
gattctgtctctgtagcgga

SEQ ID NO: 29455 - DNA, 20 bp, Artificial Sequence
  Description of Artificial Sequence: Synthetic oligonucleotide
  Target: FXN; (-) strand; PAM type: YTN; PAM sequence: CTT
ggattctgtctctgtagcgg

SEQ ID NO: 29456 - DNA, 20 bp, Artificial Sequence
  Description of Artificial Sequence: Synthetic oligonucleotide
  Target: FXN; (-) strand; PAM type: YTN; PAM sequence: CTA
tacagccagagaagatggaa

SEQ ID NO: 29457 - DNA, 20 bp, Artificial Sequence
  Description of Artificial Sequence: Synthetic oligonucleotide
  Target: FXN; (-) strand; PAM type: YTN; PAM sequence: TTA
aactatacagccagagaaga

SEQ ID NO: 29458 - DNA, 20 bp, Artificial Sequence
  Description of Artificial Sequence: Synthetic oligonucleotide
  Target: FXN; (-) strand; PAM type: YTN; PAM sequence: CTT
aaactatacagccagagaag

SEQ ID NO: 29459 - DNA, 20 bp, Artificial Sequence
  Description of Artificial Sequence: Synthetic oligonucleotide
  Target: FXN; (-) strand; PAM type: YTN; PAM sequence: TTC
cttaaactatacagccagag

SEQ ID NO: 29460 - DNA, 20 bp, Artificial Sequence
  Description of Artificial Sequence: Synthetic oligonucleotide
  Target: FXN; (-) strand; PAM type: YTN; PAM sequence: TTC
cattccttaaactatacagc

SEQ ID NO: 29461 - DNA, 20 bp, Artificial Sequence
  Description of Artificial Sequence: Synthetic oligonucleotide
  Target: FXN; (-) strand; PAM type: YTN; PAM sequence: CTT
ccattccttaaactatacag

SEQ ID NO: 29462 - DNA, 20 bp, Artificial Sequence
  Description of Artificial Sequence: Synthetic oligonucleotide
  Target: FXN; (-) strand; PAM type: YTN; PAM sequence: CTG
gtgccttccattccttaaac

SEQ ID NO: 29463 - DNA, 20 bp, Artificial Sequence
  Description of Artificial Sequence: Synthetic oligonucleotide
  Target: FXN; (-) strand; PAM type: YTN; PAM sequence: TTC
tggtgccttccattccttaa

SEQ ID NO: 29464 - DNA, 20 bp, Artificial Sequence
  Description of Artificial Sequence: Synthetic oligonucleotide
  Target: FXN; (-) strand; PAM type: YTN; PAM sequence: CTG
ttctggtgccttccattcct

SEQ ID NO: 29465 - DNA, 20 bp, Artificial Sequence
  Description of Artificial Sequence: Synthetic oligonucleotide
  Target: FXN; (-) strand; PAM type: YTN; PAM sequence: TTC
aataaatctgttctggtgcc

SEQ ID NO: 29466 - DNA, 20 bp, Artificial Sequence
  Description of Artificial Sequence: Synthetic oligonucleotide
  Target: FXN; (-) strand; PAM type: YTN; PAM sequence: TTT
caataaatctgttctggtgc

SEQ ID NO: 29467 - DNA, 20 bp, Artificial Sequence
  Description of Artificial Sequence: Synthetic oligonucleotide
  Target: FXN; (-) strand; PAM type: YTN; PAM sequence: CTA
ataaacatttcaataaatct

SEQ ID NO: 29468 - DNA, 20 bp, Artificial Sequence
  Description of Artificial Sequence: Synthetic oligonucleotide
  Target: FXN; (-) strand; PAM type: YTN; PAM sequence: TTC
agctaataaacatttcaata

SEQ ID NO: 29469 - DNA, 20 bp, Artificial Sequence
  Description of Artificial Sequence: Synthetic oligonucleotide
  Target: FXN; (-) strand; PAM type: YTN; PAM sequence: CTT
cagctaataaacatttcaat

SEQ ID NO: 29470 - DNA, 20 bp, Artificial Sequence
  Description of Artificial Sequence: Synthetic oligonucleotide
  Target: FXN; (-) strand; PAM type: YTN; PAM sequence: CTA
aataaatcttcagctaataa

SEQ ID NO: 29471 - DNA, 20 bp, Artificial Sequence
  Description of Artificial Sequence: Synthetic oligonucleotide
  Target: FXN; (-) strand; PAM type: YTN; PAM sequence: CTG
tctaaataaatcttcagcta

SEQ ID NO: 29472 - DNA, 20 bp, Artificial Sequence
  Description of Artificial Sequence: Synthetic oligonucleotide
  Target: FXN; (-) strand; PAM type: YTN; PAM sequence: CTC
aactgtctaaataaatcttc

SEQ ID NO: 29473 - DNA, 20 bp, Artificial Sequence
  Description of Artificial Sequence: Synthetic oligonucleotide
  Target: FXN; (-) strand; PAM type: YTN; PAM sequence: TTC
ctcaactgtctaaataaatc

SEQ ID NO: 29474 - DNA, 20 bp, Artificial Sequence
  Description of Artificial Sequence: Synthetic oligonucleotide
  Target: FXN; (-) strand; PAM type: YTN; PAM sequence: TTT
cctcaactgtctaaataaat

SEQ ID NO: 29475 - DNA, 20 bp, Artificial Sequence
  Description of Artificial Sequence: Synthetic oligonucleotide
  Target: FXN; (-) strand; PAM type: YTN; PAM sequence: TTT
tcctcaactgtctaaataaa

SEQ ID NO: 29476 - DNA, 20 bp, Artificial Sequence
  Description of Artificial Sequence: Synthetic oligonucleotide
  Target: FXN; (-) strand; PAM type: YTN; PAM sequence: CTG
atgttttcctcaactgtcta

SEQ ID NO: 29477 - DNA, 20 bp, Artificial Sequence
  Description of Artificial Sequence: Synthetic oligonucleotide
  Target: FXN; (-) strand; PAM type: YTN; PAM sequence: CTG
ggtgctgatgttttcctcaa

SEQ ID NO: 29478 - DNA, 20 bp, Artificial Sequence
  Description of Artificial Sequence: Synthetic oligonucleotide
  Target: FXN; (-) strand; PAM type: YTN; PAM sequence: CTG
ctgggtgctgatgttttcct

SEQ ID NO: 29479 - DNA, 20 bp, Artificial Sequence
  Description of Artificial Sequence: Synthetic oligonucleotide
  Target: FXN; (-) strand; PAM type: YTN; PAM sequence: TTA
ctgctgggtgctgatgtttt

SEQ ID NO: 29480 - DNA, 20 bp, Artificial Sequence
  Description of Artificial Sequence: Synthetic oligonucleotide
  Target: FXN; (-) strand; PAM type: YTN; PAM sequence: TTT
actgctgggtgctgatgttt

SEQ ID NO: 29481 - DNA, 20 bp, Artificial Sequence
  Description of Artificial Sequence: Synthetic oligonucleotide
  Target: FXN; (-) strand; PAM type: YTN; PAM sequence: TTT
tactgctgggtgctgatgtt

SEQ ID NO: 29482 - DNA, 20 bp, Artificial Sequence
  Description of Artificial Sequence: Synthetic oligonucleotide
  Target: FXN; (-) strand; PAM type: YTN; PAM sequence: TTG
agagccaattttactgctgg

SEQ ID NO: 29483 - DNA, 20 bp, Artificial Sequence
  Description of Artificial Sequence: Synthetic oligonucleotide
  Target: FXN; (-) strand; PAM type: YTN; PAM sequence: TTT
gagagccaattttactgctg

SEQ ID NO: 29484 - DNA, 20 bp, Artificial Sequence
  Description of Artificial Sequence: Synthetic oligonucleotide
  Target: FXN; (-) strand; PAM type: YTN; PAM sequence: CTT
tgagagccaattttactgct

SEQ ID NO: 29485 - DNA, 20 bp, Artificial Sequence
  Description of Artificial Sequence: Synthetic oligonucleotide
  Target: FXN; (-) strand; PAM type: YTN; PAM sequence: TTC
cacaggagaagaaaatcttt

SEQ ID NO: 29486 - DNA, 20 bp, Artificial Sequence
  Description of Artificial Sequence: Synthetic oligonucleotide
  Target: FXN; (-) strand; PAM type: YTN; PAM sequence: TTT
ccacaggagaagaaaatctt

SEQ ID NO: 29487 - DNA, 20 bp, Artificial Sequence
  Description of Artificial Sequence: Synthetic oligonucleotide
  Target: FXN; (-) strand; PAM type: YTN; PAM sequence: CTT
tccacaggagaagaaaatct

SEQ ID NO: 29488 - DNA, 20 bp, Artificial Sequence
  Description of Artificial Sequence: Synthetic oligonucleotide
  Target: FXN; (-) strand; PAM type: YTN; PAM sequence: CTG
actttccacaggagaagaaa

SEQ ID NO: 29489 - DNA, 20 bp, Artificial Sequence
  Description of Artificial Sequence: Synthetic oligonucleotide
  Target: FXN; (-) strand; PAM type: YTN; PAM sequence: CTC
agaggtctgactttccacag

SEQ ID NO: 29490 - DNA, 20 bp, Artificial Sequence
  Description of Artificial Sequence: Synthetic oligonucleotide
  Target: FXN; (-) strand; PAM type: YTN; PAM sequence: CTG
gatggggcctcagaggtctg

SEQ ID NO: 29491 - DNA, 20 bp, Artificial Sequence
  Description of Artificial Sequence: Synthetic oligonucleotide
  Target: FXN; (-) strand; PAM type: YTN; PAM sequence: CTA
cctggatggggcctcagagg

SEQ ID NO: 29492 - DNA, 20 bp, Artificial Sequence
  Description of Artificial Sequence: Synthetic oligonucleotide
  Target: FXN; (-) strand; PAM type: YTN; PAM sequence: TTC
tacctggatggggcctcaga

SEQ ID NO: 29493 - DNA, 20 bp, Artificial Sequence
  Description of Artificial Sequence: Synthetic oligonucleotide
  Target: FXN; (-) strand; PAM type: YTN; PAM sequence: CTT
ctacctggatggggcctcag

SEQ ID NO: 29494 - DNA, 20 bp, Artificial Sequence
  Description of Artificial Sequence: Synthetic oligonucleotide
  Target: FXN; (-) strand; PAM type: YTN; PAM sequence: CTA
gtacttctacctggatgggg

SEQ ID NO: 29495 - DNA, 20 bp, Artificial Sequence
  Description of Artificial Sequence: Synthetic oligonucleotide
  Target: FXN; (-) strand; PAM type: YTN; PAM sequence: TTG
cactagtacttctacctgga

SEQ ID NO: 29496 - DNA, 20 bp, Artificial Sequence
  Description of Artificial Sequence: Synthetic oligonucleotide
  Target: FXN; (-) strand; PAM type: YTN; PAM sequence: CTT
gcactagtacttctacctgg

SEQ ID NO: 29497 - DNA, 20 bp, Artificial Sequence
  Description of Artificial Sequence: Synthetic oligonucleotide
  Target: FXN; (-) strand; PAM type: YTN; PAM sequence: TTC
ttgcactagtacttctacct

SEQ ID NO: 29498 - DNA, 20 bp, Artificial Sequence
  Description of Artificial Sequence: Synthetic oligonucleotide
  Target: FXN; (-) strand; PAM type: YTN; PAM sequence: CTT
cttgcactagtacttctacc

SEQ ID NO: 29499 - DNA, 20 bp, Artificial Sequence
  Description of Artificial Sequence: Synthetic oligonucleotide
  Target: FXN; (-) strand; PAM type: YTN; PAM sequence: TTC
ccacagatcacagaaacaca

SEQ ID NO: 29500 - DNA, 20 bp, Artificial Sequence
  Description of Artificial Sequence: Synthetic oligonucleotide
  Target: FXN; (-) strand; PAM type: YTN; PAM sequence: TTA
acaatgttcccacagatcac

SEQ ID NO: 29501 - DNA, 20 bp, Artificial Sequence
  Description of Artificial Sequence: Synthetic oligonucleotide
  Target: FXN; (-) strand; PAM type: YTN; PAM sequence: TTG
aggtcaagatgtggcgttaa

SEQ ID NO: 29502 - DNA, 20 bp, Artificial Sequence
  Description of Artificial Sequence: Synthetic oligonucleotide
  Target: FXN; (-) strand; PAM type: YTN; PAM sequence: TTT
gaggtcaagatgtggcgtta

SEQ ID NO: 29503 - DNA, 20 bp, Artificial Sequence
  Description of Artificial Sequence: Synthetic oligonucleotide
  Target: FXN; (-) strand; PAM type: YTN; PAM sequence: CTA
aacaatttgaggtcaagatg

SEQ ID NO: 29504 - DNA, 20 bp, Artificial Sequence
  Description of Artificial Sequence: Synthetic oligonucleotide
  Target: FXN; (-) strand; PAM type: YTN; PAM sequence: CTG
gccaggagctaaacaatttg

SEQ ID NO: 29505 - DNA, 20 bp, Artificial Sequence
  Description of Artificial Sequence: Synthetic oligonucleotide
  Target: FXN; (-) strand; PAM type: YTN; PAM sequence: TTA
caggtgtgagccaccgtgtc

SEQ ID NO: 29506 - DNA, 20 bp, Artificial Sequence
  Description of Artificial Sequence: Synthetic oligonucleotide
  Target: FXN; (-) strand; PAM type: YTN; PAM sequence: CTG
ggattacaggtgtgagccac

SEQ ID NO: 29507 - DNA, 20 bp, Artificial Sequence
  Description of Artificial Sequence: Synthetic oligonucleotide
  Target: FXN; (-) strand; PAM type: YTN; PAM sequence: CTC
aaagtgctgggattacaggt

SEQ ID NO: 29508 - DNA, 20 bp, Artificial Sequence
  Description of Artificial Sequence: Synthetic oligonucleotide
  Target: FXN; (-) strand; PAM type: YTN; PAM sequence: CTC
tcaaagtgctgggattacag

SEQ ID NO: 29509 - DNA, 20 bp, Artificial Sequence
  Description of Artificial Sequence: Synthetic oligonucleotide
  Target: FXN; (-) strand; PAM type: YTN; PAM sequence: CTC
agcctctcaaagtgctggga

SEQ ID NO: 29510 - DNA, 20 bp, Artificial Sequence
  Description of Artificial Sequence: Synthetic oligonucleotide
  Target: FXN; (-) strand; PAM type: YTN; PAM sequence: CTG
cctcagcctctcaaagtgct

SEQ ID NO: 29511 - DNA, 20 bp, Artificial Sequence
  Description of Artificial Sequence: Synthetic oligonucleotide
  Target: FXN; (-) strand; PAM type: YTN; PAM sequence: CTC
aggtgatccacctgcctcag

SEQ ID NO: 29512 - DNA, 20 bp, Artificial Sequence
  Description of Artificial Sequence: Synthetic oligonucleotide
  Target: FXN; (-) strand; PAM type: YTN; PAM sequence: CTA
acctcaggtgatccacctgc

SEQ ID NO: 29513 - DNA, 20 bp, Artificial Sequence
  Description of Artificial Sequence: Synthetic oligonucleotide
  Target: FXN; (-) strand; PAM type: YTN; PAM sequence: CTC
ctaacctcaggtgatccacc

SEQ ID NO: 29514 - DNA, 20 bp, Artificial Sequence
  Description of Artificial Sequence: Synthetic oligonucleotide
  Target: FXN; (-) strand; PAM type: YTN; PAM sequence: CTC
gaactcctaacctcaggtga

SEQ ID NO: 29515 - DNA, 20 bp, Artificial Sequence
  Description of Artificial Sequence: Synthetic oligonucleotide
  Target: FXN; (-) strand; PAM type: YTN; PAM sequence: CTG
gcctcgaactcctaacctca

SEQ ID NO: 29516 - DNA, 20 bp, Artificial Sequence
  Description of Artificial Sequence: Synthetic oligonucleotide
  Target: FXN; (-) strand; PAM type: YTN; PAM sequence: TTG
accaggctggcctcgaactc

SEQ ID NO: 29517 - DNA, 20 bp, Artificial Sequence
  Description of Artificial Sequence: Synthetic oligonucleotide
  Target: FXN; (-) strand; PAM type: YTN; PAM sequence: TTA
ccatgttgaccaggctggcc

SEQ ID NO: 29518 - DNA, 20 bp, Artificial Sequence
  Description of Artificial Sequence: Synthetic oligonucleotide
  Target: FXN; (-) strand; PAM type: YTN; PAM sequence: TTT
accatgttgaccaggctggc

SEQ ID NO: 29519 - DNA, 20 bp, Artificial Sequence
  Description of Artificial Sequence: Synthetic oligonucleotide
  Target: FXN; (-) strand; PAM type: YTN; PAM sequence: TTT
taccatgttgaccaggctgg

SEQ ID NO: 29520 - DNA, 20 bp, Artificial Sequence
  Description of Artificial Sequence: Synthetic oligonucleotide
  Target: FXN; (-) strand; PAM type: YTN; PAM sequence: TTA
gtagaggcggggttttacca

SEQ ID NO: 29521 - DNA, 20 bp, Artificial Sequence
  Description of Artificial Sequence: Synthetic oligonucleotide
  Target: FXN; (-) strand; PAM type: YTN; PAM sequence: TTT
agtagaggcggggttttacc

SEQ ID NO: 29522 - DNA, 20 bp, Artificial Sequence
  Description of Artificial Sequence: Synthetic oligonucleotide
  Target: FXN; (-) strand; PAM type: YTN; PAM sequence: TTT
tagtagaggcggggttttac

SEQ ID NO: 29523 - DNA, 20 bp, Artificial Sequence
  Description of Artificial Sequence: Synthetic oligonucleotide
  Target: FXN; (-) strand; PAM type: YTN; PAM sequence: TTT
ttagtagaggcggggtttta

SEQ ID NO: 29524 - DNA, 20 bp, Artificial Sequence
  Description of Artificial Sequence: Synthetic oligonucleotide
  Target: FXN; (-) strand; PAM type: YTN; PAM sequence: TTG
tatttttagtagaggcgggg

SEQ ID NO: 29525 - DNA, 20 bp, Artificial Sequence
  Description of Artificial Sequence: Synthetic oligonucleotide
  Target: FXN; (-) strand; PAM type: YTN; PAM sequence: TTT
gtatttttagtagaggcggg

SEQ ID NO: 29526 - DNA, 20 bp, Artificial Sequence
  Description of Artificial Sequence: Synthetic oligonucleotide
  Target: FXN; (-) strand; PAM type: YTN; PAM sequence: TTT
tgtatttttagtagaggcgg

SEQ ID NO: 29527 - DNA, 20 bp, Artificial Sequence
  Description of Artificial Sequence: Synthetic oligonucleotide
  Target: FXN; (-) strand; PAM type: YTN; PAM sequence: TTT
ttgtatttttagtagaggcg

SEQ ID NO: 29528 - DNA, 20 bp, Artificial Sequence
  Description of Artificial Sequence: Synthetic oligonucleotide
  Target: FXN; (-) strand; PAM type: YTN; PAM sequence: CTA
atttttgtatttttagtaga

SEQ ID NO: 29529 - DNA, 20 bp, Artificial Sequence
  Description of Artificial Sequence: Synthetic oligonucleotide
  Target: FXN; (-) strand; PAM type: YTN; PAM sequence: CTA
cggccagctaatttttgtat

SEQ ID NO: 29530 - DNA, 20 bp, Artificial Sequence
  Description of Artificial Sequence: Synthetic oligonucleotide
  Target: FXN; (-) strand; PAM type: YTN; PAM sequence: CTG
ggataacaggcgtgcgccac

SEQ ID NO: 29531 - DNA, 20 bp, Artificial Sequence
  Description of Artificial Sequence: Synthetic oligonucleotide
  Target: FXN; (-) strand; PAM type: YTN; PAM sequence: CTC
ccgagtagctgggataacag

SEQ ID NO: 29532 - DNA, 20 bp, Artificial Sequence
  Description of Artificial Sequence: Synthetic oligonucleotide
  Target: FXN; (-) strand; PAM type: YTN; PAM sequence: CTC
agcctcccgagtagctggga

SEQ ID NO: 29533 - DNA, 20 bp, Artificial Sequence
  Description of Artificial Sequence: Synthetic oligonucleotide
  Target: FXN; (-) strand; PAM type: YTN; PAM sequence: CTG
cctcagcctcccgagtagct

SEQ ID NO: 29534 - DNA, 20 bp, Artificial Sequence
  Description of Artificial Sequence: Synthetic oligonucleotide
  Target: FXN; (-) strand; PAM type: YTN; PAM sequence: CTC
ctgcctcagcctcccgagta

SEQ ID NO: 29535 - DNA, 20 bp, Artificial Sequence
  Description of Artificial Sequence: Synthetic oligonucleotide
  Target: FXN; (-) strand; PAM type: YTN; PAM sequence: TTC
tcctgcctcagcctcccgag

SEQ ID NO: 29536 - DNA, 20 bp, Artificial Sequence
  Description of Artificial Sequence: Synthetic oligonucleotide
  Target: FXN; (-) strand; PAM type: YTN; PAM sequence: TTC
aagcaattctcctgcctcag

SEQ ID NO: 29537 - DNA, 20 bp, Artificial Sequence
  Description of Artificial Sequence: Synthetic oligonucleotide
  Target: FXN; (-) strand; PAM type: YTN; PAM sequence: CTC
caccacccaggttcaagcaa

SEQ ID NO: 29538 - DNA, 20 bp, Artificial Sequence
  Description of Artificial Sequence: Synthetic oligonucleotide
  Target: FXN; (-) strand; PAM type: YTN; PAM sequence: CTG
caacctccaccacccaggtt

SEQ ID NO: 29539 - DNA, 20 bp, Artificial Sequence
  Description of Artificial Sequence: Synthetic oligonucleotide
  Target: FXN; (-) strand; PAM type: YTN; PAM sequence: CTC
actgcaacctccaccaccca

SEQ ID NO: 29540 - DNA, 20 bp, Artificial Sequence
  Description of Artificial Sequence: Synthetic oligonucleotide
  Target: FXN; (-) strand; PAM type: YTN; PAM sequence: CTC
ggctcactgcaacctccacc

SEQ ID NO: 29541 - DNA, 20 bp, Artificial Sequence
  Description of Artificial Sequence: Synthetic oligonucleotide
  Target: FXN; (-) strand; PAM type: YTN; PAM sequence: CTG
gagtgcagtggtgtaatctc

SEQ ID NO: 29542 - DNA, 20 bp, Artificial Sequence
  Description of Artificial Sequence: Synthetic oligonucleotide
  Target: FXN; (-) strand; PAM type: YTN; PAM sequence: TTG
tcacccaggctggagtgcag

SEQ ID NO: 29543 - DNA, 20 bp, Artificial Sequence
  Description of Artificial Sequence: Synthetic oligonucleotide
  Target: FXN; (-) strand; PAM type: YTN; PAM sequence: CTT
gtcacccaggctggagtgca

SEQ ID NO: 29544 - DNA, 20 bp, Artificial Sequence
  Description of Artificial Sequence: Synthetic oligonucleotide
  Target: FXN; (-) strand; PAM type: YTN; PAM sequence: CTC
ttgtcacccaggctggagtg

SEQ ID NO: 29545 - DNA, 20 bp, Artificial Sequence
  Description of Artificial Sequence: Synthetic oligonucleotide
  Target: FXN; (-) strand; PAM type: YTN; PAM sequence: TTC
cctcttgtcacccaggctgg

SEQ ID NO: 29546 - DNA, 20 bp, Artificial Sequence
  Description of Artificial Sequence: Synthetic oligonucleotide
  Target: FXN; (-) strand; PAM type: YTN; PAM sequence: TTT
ccctcttgtcacccaggctg

SEQ ID NO: 29547 - DNA, 20 bp, Artificial Sequence
  Description of Artificial Sequence: Synthetic oligonucleotide
  Target: FXN; (-) strand; PAM type: YTN; PAM sequence: TTA
atggagtttccctcttgtca

SEQ ID NO: 29548 - DNA, 20 bp, Artificial Sequence
  Description of Artificial Sequence: Synthetic oligonucleotide
  Target: FXN; (-) strand; PAM type: YTN; PAM sequence: TTT
aatggagtttccctcttgtc

SEQ ID NO: 29549 - DNA, 20 bp, Artificial Sequence
  Description of Artificial Sequence: Synthetic oligonucleotide
  Target: FXN; (-) strand; PAM type: YTN; PAM sequence: TTT
taatggagtttccctcttgt

SEQ ID NO: 29550 - DNA, 20 bp, Artificial Sequence
  Description of Artificial Sequence: Synthetic oligonucleotide
  Target: FXN; (-) strand; PAM type: YTN; PAM sequence: TTT
ttaatggagtttccctcttg

SEQ ID NO: 29551 - DNA, 20 bp, Artificial Sequence
  Description of Artificial Sequence: Synthetic oligonucleotide
  Target: FXN; (-) strand; PAM type: YTN; PAM sequence: TTT
tttaatggagtttccctctt

SEQ ID NO: 29552 - DNA, 20 bp, Artificial Sequence
  Description of Artificial Sequence: Synthetic oligonucleotide
  Target: FXN; (-) strand; PAM type: YTN; PAM sequence: TTT
ttttaatggagtttccctct

SEQ ID NO: 29553 - DNA, 20 bp, Artificial Sequence
  Description of Artificial Sequence: Synthetic oligonucleotide
  Target: FXN; (-) strand; PAM type: YTN; PAM sequence: TTA
catttttttaatggagtttc

SEQ ID NO: 29554 - DNA, 20 bp, Artificial Sequence
  Description of Artificial Sequence: Synthetic oligonucleotide
  Target: FXN; (-) strand; PAM type: YTN; PAM sequence: TTA
agatggcagacacgggaatt

SEQ ID NO: 29555 - DNA, 20 bp, Artificial Sequence
  Description of Artificial Sequence: Synthetic oligonucleotide
  Target: FXN; (-) strand; PAM type: YTN; PAM sequence: CTT
aagatggcagacacgggaat

SEQ ID NO: 29556 - DNA, 20 bp, Artificial Sequence
  Description of Artificial Sequence: Synthetic oligonucleotide
  Target: FXN; (-) strand; PAM type: YTN; PAM sequence: TTA
cacttaagatggcagacacg

SEQ ID NO: 29557 - DNA, 20 bp, Artificial Sequence
  Description of Artificial Sequence: Synthetic oligonucleotide
  Target: FXN; (-) strand; PAM type: YTN; PAM sequence: TTT
acacttaagatggcagacac

SEQ ID NO: 29558 - DNA, 20 bp, Artificial Sequence
  Description of Artificial Sequence: Synthetic oligonucleotide
  Target: FXN; (-) strand; PAM type: YTN; PAM sequence: CTT
tacacttaagatggcagaca

SEQ ID NO: 29559 - DNA, 20 bp, Artificial Sequence
  Description of Artificial Sequence: Synthetic oligonucleotide
  Target: FXN; (-) strand; PAM type: YTN; PAM sequence: TTA
gccacctttacacttaagat

SEQ ID NO: 29560 - DNA, 20 bp, Artificial Sequence
  Description of Artificial Sequence: Synthetic oligonucleotide
  Target: FXN; (-) strand; PAM type: YTN; PAM sequence: TTT
agccacctttacacttaaga

SEQ ID NO: 29561 - DNA, 20 bp, Artificial Sequence
  Description of Artificial Sequence: Synthetic oligonucleotide
  Target: FXN; (-) strand; PAM type: YTN; PAM sequence: CTA
tataatttagccacctttac

SEQ ID NO: 29562 - DNA, 20 bp, Artificial Sequence
  Description of Artificial Sequence: Synthetic oligonucleotide
  Target: FXN; (-) strand; PAM type: YTN; PAM sequence: TTC
tatataatttagccaccttt

SEQ ID NO: 29563 - DNA, 20 bp, Artificial Sequence
  Description of Artificial Sequence: Synthetic oligonucleotide
  Target: FXN; (-) strand; PAM type: YTN; PAM sequence: TTT
ctatataatttagccacctt

SEQ ID NO: 29564 - DNA, 20 bp, Artificial Sequence
  Description of Artificial Sequence: Synthetic oligonucleotide
  Target: FXN; (-) strand; PAM type: YTN; PAM sequence: TTT
tctatataatttagccacct

SEQ ID NO: 29565 - DNA, 20 bp, Artificial Sequence
  Description of Artificial Sequence: Synthetic oligonucleotide
  Target: FXN; (-) strand; PAM type: YTN; PAM sequence: TTT
ttctatataatttagccacc

SEQ ID NO: 29566 - DNA, 20 bp, Artificial Sequence
  Description of Artificial Sequence: Synthetic oligonucleotide
  Target: FXN; (-) strand; PAM type: YTN; PAM sequence: TTA
tttttctatataatttagcc

SEQ ID NO: 29567 - DNA, 20 bp, Artificial Sequence
  Description of Artificial Sequence: Synthetic oligonucleotide
  Target: FXN; (-) strand; PAM type: YTN; PAM sequence: CTT
atttttctatataatttagc

SEQ ID NO: 29568 - DNA, 20 bp, Artificial Sequence
  Description of Artificial Sequence: Synthetic oligonucleotide
  Target: FXN; (-) strand; PAM type: YTN; PAM sequence: TTG
tcttatttttctatataatt

SEQ ID NO: 29569 - DNA, 20 bp, Artificial Sequence
  Description of Artificial Sequence: Synthetic oligonucleotide
  Target: FXN; (-) strand; PAM type: YTN; PAM sequence: TTG
ggaaatgatattgtcttatt

SEQ ID NO: 29570 - DNA, 20 bp, Artificial Sequence
  Description of Artificial Sequence: Synthetic oligonucleotide
  Target: FXN; (-) strand; PAM type: YTN; PAM sequence: CTA
gcatcatagagtgcggtagg

SEQ ID NO: 29571 - DNA, 20 bp, Artificial Sequence
  Description of Artificial Sequence: Synthetic oligonucleotide
  Target: FXN; (-) strand; PAM type: YTN; PAM sequence: CTC
agctagcatcatagagtgcg

SEQ ID NO: 29572 - DNA, 20 bp, Artificial Sequence
  Description of Artificial Sequence: Synthetic oligonucleotide
  Target: FXN; (-) strand; PAM type: YTN; PAM sequence: TTG
gaaaaatctcagctagcatc

SEQ ID NO: 29573 - DNA, 20 bp, Artificial Sequence
  Description of Artificial Sequence: Synthetic oligonucleotide
  Target: FXN; (-) strand; PAM type: YTN; PAM sequence: TTT
ggaaaaatctcagctagcat

SEQ ID NO: 29574 - DNA, 20 bp, Artificial Sequence
  Description of Artificial Sequence: Synthetic oligonucleotide
  Target: FXN; (-) strand; PAM type: YTN; PAM sequence: TTT
tggaaaaatctcagctagca

SEQ ID NO: 29575 - DNA, 20 bp, Artificial Sequence
  Description of Artificial Sequence: Synthetic oligonucleotide
  Target: FXN; (-) strand; PAM type: YTN; PAM sequence: CTT
ttggaaaaatctcagctagc

SEQ ID NO: 29576 - DNA, 20 bp, Artificial Sequence
  Description of Artificial Sequence: Synthetic oligonucleotide
  Target: FXN; (-) strand; PAM type: YTN; PAM sequence: TTC
ttttggaaaaatctcagcta

SEQ ID NO: 29577 - DNA, 20 bp, Artificial Sequence
  Description of Artificial Sequence: Synthetic oligonucleotide
  Target: FXN; (-) strand; PAM type: YTN; PAM sequence: TTT
cttttggaaaaatctcagct

SEQ ID NO: 29578 - DNA, 20 bp, Artificial Sequence
  Description of Artificial Sequence: Synthetic oligonucleotide
  Target: FXN; (-) strand; PAM type: YTN; PAM sequence: TTT
tcttttggaaaaatctcagc

SEQ ID NO: 29579 - DNA, 20 bp, Artificial Sequence
  Description of Artificial Sequence: Synthetic oligonucleotide
  Target: FXN; (-) strand; PAM type: YTN; PAM sequence: TTA
agccattttcttttggaaaa

SEQ ID NO: 29580 - DNA, 20 bp, Artificial Sequence
  Description of Artificial Sequence: Synthetic oligonucleotide
  Target: FXN; (-) strand; PAM type: YTN; PAM sequence: TTT
aagccattttcttttggaaa

SEQ ID NO: 29581 - DNA, 20 bp, Artificial Sequence
  Description of Artificial Sequence: Synthetic oligonucleotide
  Target: FXN; (-) strand; PAM type: YTN; PAM sequence: TTA
tttaagccattttcttttgg

SEQ ID NO: 29582 - DNA, 20 bp, Artificial Sequence
  Description of Artificial Sequence: Synthetic oligonucleotide
  Target: FXN; (-) strand; PAM type: YTN; PAM sequence: TTT
atttaagccattttcttttg

SEQ ID NO: 29583 - DNA, 20 bp, Artificial Sequence
  Description of Artificial Sequence: Synthetic oligonucleotide
  Target: FXN; (-) strand; PAM type: YTN; PAM sequence: TTT
tatttaagccattttctttt

SEQ ID NO: 29584 - DNA, 20 bp, Artificial Sequence
  Description of Artificial Sequence: Synthetic oligonucleotide
  Target: FXN; (-) strand; PAM type: YTN; PAM sequence: TTA
gggttttatttaagccattt

SEQ ID NO: 29585 - DNA, 20 bp, Artificial Sequence
  Description of Artificial Sequence: Synthetic oligonucleotide
  Target: FXN; (-) strand; PAM type: YTN; PAM sequence: CTT
agggttttatttaagccatt

SEQ ID NO: 29586 - DNA, 20 bp, Artificial Sequence
  Description of Artificial Sequence: Synthetic oligonucleotide
  Target: FXN; (-) strand; PAM type: YTN; PAM sequence: CTC
ttagggttttatttaagcca

SEQ ID NO: 29587 - DNA, 20 bp, Artificial Sequence
  Description of Artificial Sequence: Synthetic oligonucleotide
  Target: FXN; (-) strand; PAM type: YTN; PAM sequence: TTC
tcttagggttttatttaagc

SEQ ID NO: 29588 - DNA, 20 bp, Artificial Sequence
  Description of Artificial Sequence: Synthetic oligonucleotide
  Target: FXN; (-) strand; PAM type: YTN; PAM sequence: TTT
ctcttagggttttatttaag

SEQ ID NO: 29589 - DNA, 20 bp, Artificial Sequence
  Description of Artificial Sequence: Synthetic oligonucleotide
  Target: FXN; (-) strand; PAM type: YTN; PAM sequence: CTT
tctcttagggttttatttaa

SEQ ID NO: 29590 - DNA, 20 bp, Artificial Sequence
  Description of Artificial Sequence: Synthetic oligonucleotide
  Target: FXN; (-) strand; PAM type: YTN; PAM sequence: TTC
tttctcttagggttttattt

SEQ ID NO: 29591 - DNA, 20 bp, Artificial Sequence
  Description of Artificial Sequence: Synthetic oligonucleotide
  Target: FXN; (-) strand; PAM type: YTN; PAM sequence: TTT
ctttctcttagggttttatt

SEQ ID NO: 29592 - DNA, 20 bp, Artificial Sequence
  Description of Artificial Sequence: Synthetic oligonucleotide
  Target: FXN; (-) strand; PAM type: YTN; PAM sequence: TTT
tctttctcttagggttttat

SEQ ID NO: 29593 - DNA, 20 bp, Artificial Sequence
  Description of Artificial Sequence: Synthetic oligonucleotide
  Target: FXN; (-) strand; PAM type: YTN; PAM sequence: TTT
ttctttctcttagggtttta

SEQ ID NO: 29594 - DNA, 20 bp, Artificial Sequence
  Description of Artificial Sequence: Synthetic oligonucleotide
  Target: FXN; (-) strand; PAM type: YTN; PAM sequence: TTA
aagtttttctttctcttagg

SEQ ID NO: 29595 - DNA, 20 bp, Artificial Sequence
  Description of Artificial Sequence: Synthetic oligonucleotide
  Target: FXN; (-) strand; PAM type: YTN; PAM sequence: TTT
aaagtttttctttctcttag

SEQ ID NO: 29596 - DNA, 20 bp, Artificial Sequence
  Description of Artificial Sequence: Synthetic oligonucleotide
  Target: FXN; (-) strand; PAM type: YTN; PAM sequence: TTG
gagggatttaaagtttttct

SEQ ID NO: 29597 - DNA, 20 bp, Artificial Sequence
  Description of Artificial Sequence: Synthetic oligonucleotide
  Target: FXN; (-) strand; PAM type: YTN; PAM sequence: TTT
ggagggatttaaagtttttc

SEQ ID NO: 29598 - DNA, 20 bp, Artificial Sequence
  Description of Artificial Sequence: Synthetic oligonucleotide
  Target: FXN; (-) strand; PAM type: YTN; PAM sequence: CTT
tggagggatttaaagttttt

SEQ ID NO: 29599 - DNA, 20 bp, Artificial Sequence
  Description of Artificial Sequence: Synthetic oligonucleotide
  Target: FXN; (-) strand; PAM type: YTN; PAM sequence: TTG
agctttggagggatttaaag

SEQ ID NO: 29600 - DNA, 20 bp, Artificial Sequence
  Description of Artificial Sequence: Synthetic oligonucleotide
  Target: FXN; (-) strand; PAM type: YTN; PAM sequence: TTT
gagctttggagggatttaaa

SEQ ID NO: 29601 - DNA, 20 bp, Artificial Sequence
  Description of Artificial Sequence: Synthetic oligonucleotide
  Target: FXN; (-) strand; PAM type: YTN; PAM sequence: TTT
tgagctttggagggatttaa

SEQ ID NO: 29602 - DNA, 20 bp, Artificial Sequence
  Description of Artificial Sequence: Synthetic oligonucleotide
  Target: FXN; (-) strand; PAM type: YTN; PAM sequence: CTT
ttgagctttggagggattta

SEQ ID NO: 29603 - DNA, 20 bp, Artificial Sequence
  Description of Artificial Sequence: Synthetic oligonucleotide
  Target: FXN; (-) strand; PAM type: YTN; PAM sequence: TTA
cttttgagctttggagggat

SEQ ID NO: 29604 - DNA, 20 bp, Artificial Sequence
  Description of Artificial Sequence: Synthetic oligonucleotide
  Target: FXN; (-) strand; PAM type: YTN; PAM sequence: CTA
ttacttttgagctttggagg

SEQ ID NO: 29605 - DNA, 20 bp, Artificial Sequence
  Description of Artificial Sequence: Synthetic oligonucleotide
  Target: FXN; (-) strand; PAM type: YTN; PAM sequence: TTC
tattacttttgagctttgga

SEQ ID NO: 29606 - DNA, 20 bp, Artificial Sequence
  Description of Artificial Sequence: Synthetic oligonucleotide
  Target: FXN; (-) strand; PAM type: YTN; PAM sequence: TTT
ctattacttttgagctttgg

SEQ ID NO: 29607 - DNA, 20 bp, Artificial Sequence
  Description of Artificial Sequence: Synthetic oligonucleotide
  Target: FXN; (-) strand; PAM type: YTN; PAM sequence: CTG
tttctattacttttgagctt

SEQ ID NO: 29608 - DNA, 20 bp, Artificial Sequence
  Description of Artificial Sequence: Synthetic oligonucleotide
  Target: FXN; (-) strand; PAM type: YTN; PAM sequence: CTC
atctgtttctattacttttg

SEQ ID NO: 29609 - DNA, 20 bp, Artificial Sequence
  Description of Artificial Sequence: Synthetic oligonucleotide
  Target: FXN; (-) strand; PAM type: YTN; PAM sequence: CTC
caaactcatctgtttctatt

SEQ ID NO: 29610 - DNA, 20 bp, Artificial Sequence
  Description of Artificial Sequence: Synthetic oligonucleotide
  Target: FXN; (-) strand; PAM type: YTN; PAM sequence: CTG
actccaaactcatctgtttc

SEQ ID NO: 29611 - DNA, 20 bp, Artificial Sequence
  Description of Artificial Sequence: Synthetic oligonucleotide
  Target: FXN; (-) strand; PAM type: YTN; PAM sequence: TTA
cagagaaatcctgactccaa

SEQ ID NO: 29612 - DNA, 20 bp, Artificial Sequence
  Description of Artificial Sequence: Synthetic oligonucleotide
  Target: FXN; (-) strand; PAM type: YTN; PAM sequence: CTT
acagagaaatcctgactcca

SEQ ID NO: 29613 - DNA, 20 bp, Artificial Sequence
  Description of Artificial Sequence: Synthetic oligonucleotide
  Target: FXN; (-) strand; PAM type: YTN; PAM sequence: CTA
ggcaatcttacagagaaatc

SEQ ID NO: 29614 - DNA, 20 bp, Artificial Sequence
  Description of Artificial Sequence: Synthetic oligonucleotide
  Target: FXN; (-) strand; PAM type: YTN; PAM sequence: CTG
gagatgtgcagtacacagcc

SEQ ID NO: 29615 - DNA, 20 bp, Artificial Sequence
  Description of Artificial Sequence: Synthetic oligonucleotide
  Target: FXN; (-) strand; PAM type: YTN; PAM sequence: CTG
tcaacagtggcacctggaga

SEQ ID NO: 29616 - DNA, 20 bp, Artificial Sequence
  Description of Artificial Sequence: Synthetic oligonucleotide
  Target: FXN; (-) strand; PAM type: YTN; PAM sequence: CTC
tgtcaacagtggcacctgga

SEQ ID NO: 29617 - DNA, 20 bp, Artificial Sequence
  Description of Artificial Sequence: Synthetic oligonucleotide
  Target: FXN; (-) strand; PAM type: YTN; PAM sequence: TTA
taatctctgtcaacagtggc

SEQ ID NO: 29618 - DNA, 20 bp, Artificial Sequence
  Description of Artificial Sequence: Synthetic oligonucleotide
  Target: FXN; (-) strand; PAM type: YTN; PAM sequence: TTG
tagttataatctctgtcaac

SEQ ID NO: 29619 - DNA, 20 bp, Artificial Sequence
  Description of Artificial Sequence: Synthetic oligonucleotide
  Target: FXN; (-) strand; PAM type: YTN; PAM sequence: TTC
acattgtagttataatctct

SEQ ID NO: 29620 - DNA, 20 bp, Artificial Sequence
  Description of Artificial Sequence: Synthetic oligonucleotide
  Target: FXN; (-) strand; PAM type: YTN; PAM sequence: CTT
cacattgtagttataatctc

SEQ ID NO: 29621 - DNA, 20 bp, Artificial Sequence
  Description of Artificial Sequence: Synthetic oligonucleotide
  Target: FXN; (-) strand; PAM type: YTN; PAM sequence: TTC
acttcacattgtagttataa

SEQ ID NO: 29622 - DNA, 20 bp, Artificial Sequence
  Description of Artificial Sequence: Synthetic oligonucleotide
  Target: FXN; (-) strand; PAM type: YTN; PAM sequence: CTG
tcagtggcaccattcacttc

SEQ ID NO: 29623 - DNA, 20 bp, Artificial Sequence
  Description of Artificial Sequence: Synthetic oligonucleotide
  Target: FXN; (-) strand; PAM type: YTN; PAM sequence: TTG
cataactgtcagtggcacca

SEQ ID NO: 29624 - DNA, 20 bp, Artificial Sequence
  Description of Artificial Sequence: Synthetic oligonucleotide
  Target: FXN; (-) strand; PAM type: YTN; PAM sequence: TTT
gcataactgtcagtggcacc

SEQ ID NO: 29625 - DNA, 20 bp, Artificial Sequence
  Description of Artificial Sequence: Synthetic oligonucleotide
  Target: FXN; (-) strand; PAM type: YTN; PAM sequence: CTG
gacggtttgcataactgtca

SEQ ID NO: 29626 - DNA, 20 bp, Artificial Sequence
  Description of Artificial Sequence: Synthetic oligonucleotide
  Target: FXN; (-) strand; PAM type: YTN; PAM sequence: CTC
tggacggtttgcataactgt

SEQ ID NO: 29627 - DNA, 20 bp, Artificial Sequence
  Description of Artificial Sequence: Synthetic oligonucleotide
  Target: FXN; (-) strand; PAM type: YTN; PAM sequence: CTA
tgctctggacggtttgcata

SEQ ID NO: 29628 - DNA, 20 bp, Artificial Sequence
  Description of Artificial Sequence: Synthetic oligonucleotide
  Target: FXN; (-) strand; PAM type: YTN; PAM sequence: CTG
gcaagaggaatcccagcagg

SEQ ID NO: 29629 - DNA, 20 bp, Artificial Sequence
  Description of Artificial Sequence: Synthetic oligonucleotide
  Target: FXN; (-) strand; PAM type: YTN; PAM sequence: CTG
atggactggcaagaggaatc

SEQ ID NO: 29630 - DNA, 20 bp, Artificial Sequence
  Description of Artificial Sequence: Synthetic oligonucleotide
  Target: FXN; (-) strand; PAM type: YTN; PAM sequence: CTG
ctgatggactggcaagagga

SEQ ID NO: 29631 - DNA, 20 bp, Artificial Sequence
  Description of Artificial Sequence: Synthetic oligonucleotide
  Target: FXN; (-) strand; PAM type: YTN; PAM sequence: TTC
aaggggaactgctgatggac

SEQ ID NO: 29632 - DNA, 20 bp, Artificial Sequence
  Description of Artificial Sequence: Synthetic oligonucleotide
  Target: FXN; (-) strand; PAM type: YTN; PAM sequence: TTT
caaggggaactgctgatgga

SEQ ID NO: 29633 - DNA, 20 bp, Artificial Sequence
  Description of Artificial Sequence: Synthetic oligonucleotide
  Target: FXN; (-) strand; PAM type: YTN; PAM sequence: CTT
tcaaggggaactgctgatgg

SEQ ID NO: 29634 - DNA, 20 bp, Artificial Sequence
  Description of Artificial Sequence: Synthetic oligonucleotide
  Target: FXN; (-) strand; PAM type: YTN; PAM sequence: TTG
gtgaaactttcaaggggaac

SEQ ID NO: 29635 - DNA, 20 bp, Artificial Sequence
  Description of Artificial Sequence: Synthetic oligonucleotide
  Target: FXN; (-) strand; PAM type: YTN; PAM sequence: TTT
ggtgaaactttcaaggggaa

SEQ ID NO: 29636 - DNA, 20 bp, Artificial Sequence
  Description of Artificial Sequence: Synthetic oligonucleotide
  Target: FXN; (-) strand; PAM type: YTN; PAM sequence: TTA
agggatgtttggtgaaactt

SEQ ID NO: 29637 - DNA, 20 bp, Artificial Sequence
  Description of Artificial Sequence: Synthetic oligonucleotide
  Target: FXN; (-) strand; PAM type: YTN; PAM sequence: TTT
aagggatgtttggtgaaact

SEQ ID NO: 29638 - DNA, 20 bp, Artificial Sequence
  Description of Artificial Sequence: Synthetic oligonucleotide
  Target: FXN; (-) strand; PAM type: YTN; PAM sequence: CTG
gggacgggcaggagagggca

SEQ ID NO: 29639 - DNA, 20 bp, Artificial Sequence
  Description of Artificial Sequence: Synthetic oligonucleotide
  Target: FXN; (-) strand; PAM type: YTN; PAM sequence: CTC
cactggggacgggcaggaga

SEQ ID NO: 29640 - DNA, 20 bp, Artificial Sequence
  Description of Artificial Sequence: Synthetic oligonucleotide
  Target: FXN; (-) strand; PAM type: YTN; PAM sequence: CTG
caaaaatgcaggtgaaaaat

SEQ ID NO: 29641 - DNA, 20 bp, Artificial Sequence
  Description of Artificial Sequence: Synthetic oligonucleotide
  Target: FXN; (-) strand; PAM type: YTN; PAM sequence: CTC
ctgcaaaaatgcaggtgaaa

SEQ ID NO: 29642 - DNA, 20 bp, Artificial Sequence
  Description of Artificial Sequence: Synthetic oligonucleotide
  Target: FXN; (-) strand; PAM type: YTN; PAM sequence: CTG
agagaaaaggaggaaggtgg

SEQ ID NO: 29643 - DNA, 20 bp, Artificial Sequence
  Description of Artificial Sequence: Synthetic oligonucleotide
  Target: FXN; (-) strand; PAM type: YTN; PAM sequence: CTA
gatgatgggctgagagaaaa

SEQ ID NO: 29644 - DNA, 20 bp, Artificial Sequence
  Description of Artificial Sequence: Synthetic oligonucleotide
  Target: FXN; (-) strand; PAM type: YTN; PAM sequence: CTG
tgtagctagatgatgggctg

SEQ ID NO: 29645 - DNA, 20 bp, Artificial Sequence
  Description of Artificial Sequence: Synthetic oligonucleotide
  Target: FXN; (-) strand; PAM type: YTN; PAM sequence: CTG
gagactgtgtagctagatga

SEQ ID NO: 29646 - DNA, 20 bp, Artificial Sequence
  Description of Artificial Sequence: Synthetic oligonucleotide
  Target: FXN; (-) strand; PAM type: YTN; PAM sequence: TTA
ccctggagactgtgtagcta

SEQ ID NO: 29647 - DNA, 20 bp, Artificial Sequence
  Description of Artificial Sequence: Synthetic oligonucleotide
  Target: FXN; (-) strand; PAM type: YTN; PAM sequence: CTT
accctggagactgtgtagct

SEQ ID NO: 29648 - DNA, 20 bp, Artificial Sequence
  Description of Artificial Sequence: Synthetic oligonucleotide
  Target: FXN; (-) strand; PAM type: YTN; PAM sequence: CTG
aaagcttaccctggagactg

SEQ ID NO: 29649 - DNA, 20 bp, Artificial Sequence
  Description of Artificial Sequence: Synthetic oligonucleotide
  Target: FXN; (-) strand; PAM type: YTN; PAM sequence: TTC
tgaaagcttaccctggagac

SEQ ID NO: 29650 - DNA, 20 bp, Artificial Sequence
  Description of Artificial Sequence: Synthetic oligonucleotide
  Target: FXN; (-) strand; PAM type: YTN; PAM sequence: TTT
ctgaaagcttaccctggaga

SEQ ID NO: 29651 - DNA, 20 bp, Artificial Sequence
  Description of Artificial Sequence: Synthetic oligonucleotide
  Target: FXN; (-) strand; PAM type: YTN; PAM sequence: CTT
tctgaaagcttaccctggag

SEQ ID NO: 29652 - DNA, 20 bp, Artificial Sequence
  Description of Artificial Sequence: Synthetic oligonucleotide
  Target: FXN; (-) strand; PAM type: YTN; PAM sequence: TTG
cctttctgaaagcttaccct

SEQ ID NO: 29653 - DNA, 20 bp, Artificial Sequence
  Description of Artificial Sequence: Synthetic oligonucleotide
  Target: FXN; (-) strand; PAM type: YTN; PAM sequence: TTA
cagacaagagattgcctttc

SEQ ID NO: 29654 - DNA, 20 bp, Artificial Sequence
  Description of Artificial Sequence: Synthetic oligonucleotide
  Target: FXN; (-) strand; PAM type: YTN; PAM sequence: TTT
acagacaagagattgccttt

SEQ ID NO: 29655 - DNA, 20 bp, Artificial Sequence
  Description of Artificial Sequence: Synthetic oligonucleotide
  Target: FXN; (-) strand; PAM type: YTN; PAM sequence: TTT
tacagacaagagattgcctt

SEQ ID NO: 29656 - DNA, 20 bp, Artificial Sequence
  Description of Artificial Sequence: Synthetic oligonucleotide
  Target: FXN; (-) strand; PAM type: YTN; PAM sequence: TTA
ggttttacagacaagagatt

SEQ ID NO: 29657 - DNA, 20 bp, Artificial Sequence
  Description of Artificial Sequence: Synthetic oligonucleotide
  Target: FXN; (-) strand; PAM type: YTN; PAM sequence: CTT
aggttttacagacaagagat

SEQ ID NO: 29658 - DNA, 20 bp, Artificial Sequence
  Description of Artificial Sequence: Synthetic oligonucleotide
  Target: FXN; (-) strand; PAM type: YTN; PAM sequence: CTG
cttaggttttacagacaaga

SEQ ID NO: 29659 - DNA, 20 bp, Artificial Sequence
  Description of Artificial Sequence: Synthetic oligonucleotide
  Target: FXN; (-) strand; PAM type: YTN; PAM sequence: TTG
gtcctgcttaggttttacag

SEQ ID NO: 29660 - DNA, 20 bp, Artificial Sequence
  Description of Artificial Sequence: Synthetic oligonucleotide
  Target: FXN; (-) strand; PAM type: YTN; PAM sequence: CTT
ggtcctgcttaggttttaca

SEQ ID NO: 29661 - DNA, 20 bp, Artificial Sequence
  Description of Artificial Sequence: Synthetic oligonucleotide
  Target: FXN; (-) strand; PAM type: YTN; PAM sequence: TTG
gccttggtcctgcttaggtt

SEQ ID NO: 29662 - DNA, 20 bp, Artificial Sequence
  Description of Artificial Sequence: Synthetic oligonucleotide
  Target: FXN; (-) strand; PAM type: YTN; PAM sequence: CTT
ggccttggtcctgcttaggt

SEQ ID NO: 29663 - DNA, 20 bp, Artificial Sequence
  Description of Artificial Sequence: Synthetic oligonucleotide
  Target: FXN; (-) strand; PAM type: YTN; PAM sequence: CTA
agaaacttggccttggtcct

SEQ ID NO: 29664 - DNA, 20 bp, Artificial Sequence
  Description of Artificial Sequence: Synthetic oligonucleotide
  Target: FXN; (-) strand; PAM type: YTN; PAM sequence: TTC
aggctaagaaacttggcctt

SEQ ID NO: 29665 - DNA, 20 bp, Artificial Sequence
  Description of Artificial Sequence: Synthetic oligonucleotide
  Target: FXN; (-) strand; PAM type: YTN; PAM sequence: TTT
caggctaagaaacttggcct

SEQ ID NO: 29666 - DNA, 20 bp, Artificial Sequence
  Description of Artificial Sequence: Synthetic oligonucleotide
  Target: FXN; (-) strand; PAM type: YTN; PAM sequence: TTT
tcaggctaagaaacttggcc

SEQ ID NO: 29667 - DNA, 20 bp, Artificial Sequence
  Description of Artificial Sequence: Synthetic oligonucleotide
  Target: FXN; (-) strand; PAM type: YTN; PAM sequence: TTT
ttcaggctaagaaacttggc

SEQ ID NO: 29668 - DNA, 20 bp, Artificial Sequence
  Description of Artificial Sequence: Synthetic oligonucleotide
  Target: FXN; (-) strand; PAM type: YTN; PAM sequence: TTC
agtcagaaaagcacattttt

SEQ ID NO: 29669 - DNA, 20 bp, Artificial Sequence
  Description of Artificial Sequence: Synthetic oligonucleotide
  Target: FXN; (-) strand; PAM type: YTN; PAM sequence: CTG
aacagttcagtcagaaaagc

SEQ ID NO: 29670 - DNA, 20 bp, Artificial Sequence
  Description of Artificial Sequence: Synthetic oligonucleotide
  Target: FXN; (-) strand; PAM type: YTN; PAM sequence: TTA
tatgtagagtcagtgcctga

SEQ ID NO: 29671 - DNA, 20 bp, Artificial Sequence
  Description of Artificial Sequence: Synthetic oligonucleotide
  Target: FXN; (-) strand; PAM type: YTN; PAM sequence: TTG
agtgtgagggggtagaaaag

SEQ ID NO: 29672 - DNA, 20 bp, Artificial Sequence
  Description of Artificial Sequence: Synthetic oligonucleotide
  Target: FXN; (-) strand; PAM type: YTN; PAM sequence: CTG
gagtcaaagtgttgagtgtg

SEQ ID NO: 29673 - DNA, 20 bp, Artificial Sequence
  Description of Artificial Sequence: Synthetic oligonucleotide
  Target: FXN; (-) strand; PAM type: YTN; PAM sequence: TTG
ctggagtcaaagtgttgagt

SEQ ID NO: 29674 - DNA, 20 bp, Artificial Sequence
  Description of Artificial Sequence: Synthetic oligonucleotide
  Target: FXN; (-) strand; PAM type: YTN; PAM sequence: TTG
ggattgctggagtcaaagtg

SEQ ID NO: 29675 - DNA, 20 bp, Artificial Sequence
  Description of Artificial Sequence: Synthetic oligonucleotide
  Target: FXN; (-) strand; PAM type: YTN; PAM sequence: TTT
gggattgctggagtcaaagt

SEQ ID NO: 29676 - DNA, 20 bp, Artificial Sequence
  Description of Artificial Sequence: Synthetic oligonucleotide
  Target: FXN; (-) strand; PAM type: YTN; PAM sequence: CTG
gggatttgggattgctggag

SEQ ID NO: 29677 - DNA, 20 bp, Artificial Sequence
  Description of Artificial Sequence: Synthetic oligonucleotide
  Target: FXN; (-) strand; PAM type: YTN; PAM sequence: TTA
gggatctggggatttgggat

SEQ ID NO: 29678 - DNA, 20 bp, Artificial Sequence
  Description of Artificial Sequence: Synthetic oligonucleotide
  Target: FXN; (-) strand; PAM type: YTN; PAM sequence: CTT
agggatctggggatttggga

SEQ ID NO: 29679 - DNA, 20 bp, Artificial Sequence
  Description of Artificial Sequence: Synthetic oligonucleotide
  Target: FXN; (-) strand; PAM type: YTN; PAM sequence: CTG
agagccacgtgaaaatagca

SEQ ID NO: 29680 - DNA, 20 bp, Artificial Sequence
  Description of Artificial Sequence: Synthetic oligonucleotide
  Target: FXN; (-) strand; PAM type: YTN; PAM sequence: CTG
gccaagtctgagagccacgt

SEQ ID NO: 29681 - DNA, 20 bp, Artificial Sequence
  Description of Artificial Sequence: Synthetic oligonucleotide
  Target: FXN; (-) strand; PAM type: YTN; PAM sequence: CTA
ccccccaggcagagatgtgg

SEQ ID NO: 29682 - DNA, 20 bp, Artificial Sequence
  Description of Artificial Sequence: Synthetic oligonucleotide
  Target: FXN; (-) strand; PAM type: YTN; PAM sequence: TTC
agggtagaatctacccccca

SEQ ID NO: 29683 - DNA, 20 bp, Artificial Sequence
  Description of Artificial Sequence: Synthetic oligonucleotide
  Target: FXN; (-) strand; PAM type: YTN; PAM sequence: TTT
cagggtagaatctacccccc

SEQ ID NO: 29684 - DNA, 20 bp, Artificial Sequence
  Description of Artificial Sequence: Synthetic oligonucleotide
  Target: FXN; (-) strand; PAM type: YTN; PAM sequence: TTT
tcagggtagaatctaccccc

SEQ ID NO: 29685 - DNA, 20 bp, Artificial Sequence
  Description of Artificial Sequence: Synthetic oligonucleotide
  Target: FXN; (-) strand; PAM type: YTN; PAM sequence: TTT
ttcagggtagaatctacccc

SEQ ID NO: 29686 - DNA, 20 bp, Artificial Sequence
  Description of Artificial Sequence: Synthetic oligonucleotide
  Target: FXN; (-) strand; PAM type: YTN; PAM sequence: CTG
tgccaagaacatttttcagg

SEQ ID NO: 29687 - DNA, 20 bp, Artificial Sequence
  Description of Artificial Sequence: Synthetic oligonucleotide
  Target: FXN; (-) strand; PAM type: YTN; PAM sequence: TTG
caaggctgtgccaagaacat

SEQ ID NO: 29688 - DNA, 20 bp, Artificial Sequence
  Description of Artificial Sequence: Synthetic oligonucleotide
  Target: FXN; (-) strand; PAM type: YTN; PAM sequence: TTT
gcaaggctgtgccaagaaca

SEQ ID NO: 29689 - DNA, 20 bp, Artificial Sequence
  Description of Artificial Sequence: Synthetic oligonucleotide
  Target: FXN; (-) strand; PAM type: YTN; PAM sequence: CTG
agtggaggaggagtttgcaa

SEQ ID NO: 29690 - DNA, 20 bp, Artificial Sequence
  Description of Artificial Sequence: Synthetic oligonucleotide
  Target: FXN; (-) strand; PAM type: YTN; PAM sequence: CTG
aggacatggaacaatcaagg

SEQ ID NO: 29691 - DNA, 20 bp, Artificial Sequence
  Description of Artificial Sequence: Synthetic oligonucleotide
  Target: FXN; (-) strand; PAM type: YTN; PAM sequence: CTG
ggaaagacaaacatggtatg

SEQ ID NO: 29692 - DNA, 20 bp, Artificial Sequence
  Description of Artificial Sequence: Synthetic oligonucleotide
  Target: FXN; (-) strand; PAM type: YTN; PAM sequence: CTC
atggaaggtacagccaagca

SEQ ID NO: 29693 - DNA, 20 bp, Artificial Sequence
  Description of Artificial Sequence: Synthetic oligonucleotide
  Target: FXN; (-) strand; PAM type: YTN; PAM sequence: CTA
gcctcatggaaggtacagcc

SEQ ID NO: 29694 - DNA, 20 bp, Artificial Sequence
  Description of Artificial Sequence: Synthetic oligonucleotide
  Target: FXN; (-) strand; PAM type: YTN; PAM sequence: CTA
gggcaacagcagtcaacaaa

SEQ ID NO: 29695 - DNA, 20 bp, Artificial Sequence
  Description of Artificial Sequence: Synthetic oligonucleotide
  Target: FXN; (-) strand; PAM type: YTN; PAM sequence: CTG
tgcaagatgctagggcaaca

SEQ ID NO: 29696 - DNA, 20 bp, Artificial Sequence
  Description of Artificial Sequence: Synthetic oligonucleotide
  Target: FXN; (-) strand; PAM type: YTN; PAM sequence: TTG
tgtgcaaggaactgtgcaag

SEQ ID NO: 29697 - DNA, 20 bp, Artificial Sequence
  Description of Artificial Sequence: Synthetic oligonucleotide
  Target: FXN; (-) strand; PAM type: YTN; PAM sequence: CTA
attgtgtgcaaggaactgtg

SEQ ID NO: 29698 - DNA, 20 bp, Artificial Sequence
  Description of Artificial Sequence: Synthetic oligonucleotide
  Target: FXN; (-) strand; PAM type: YTN; PAM sequence: CTC
taattgtgtgcaaggaactg

SEQ ID NO: 29699 - DNA, 20 bp, Artificial Sequence
  Description of Artificial Sequence: Synthetic oligonucleotide
  Target: FXN; (-) strand; PAM type: YTN; PAM sequence: TTA
tagagctctaattgtgtgca

SEQ ID NO: 29700 - DNA, 20 bp, Artificial Sequence
  Description of Artificial Sequence: Synthetic oligonucleotide
  Target: FXN; (-) strand; PAM type: YTN; PAM sequence: TTT
atagagctctaattgtgtgc

SEQ ID NO: 29701 - DNA, 20 bp, Artificial Sequence
  Description of Artificial Sequence: Synthetic oligonucleotide
  Target: FXN; (-) strand; PAM type: YTN; PAM sequence: TTG
acatttatagagctctaatt

SEQ ID NO: 29702 - DNA, 20 bp, Artificial Sequence
  Description of Artificial Sequence: Synthetic oligonucleotide
  Target: FXN; (-) strand; PAM type: YTN; PAM sequence: TTT
gacatttatagagctctaat

SEQ ID NO: 29703 - DNA, 20 bp, Artificial Sequence
  Description of Artificial Sequence: Synthetic oligonucleotide
  Target: FXN; (-) strand; PAM type: YTN; PAM sequence: TTA
tttgacatttatagagctct

SEQ ID NO: 29704 - DNA, 20 bp, Artificial Sequence
  Description of Artificial Sequence: Synthetic oligonucleotide
  Target: FXN; (-) strand; PAM type: YTN; PAM sequence: TTT
atttgacatttatagagctc

SEQ ID NO: 29705 - DNA, 20 bp, Artificial Sequence
  Description of Artificial Sequence: Synthetic oligonucleotide
  Target: FXN; (-) strand; PAM type: YTN; PAM sequence: TTA
taacacatttatttgacatt

SEQ ID NO: 29706 - DNA, 20 bp, Artificial Sequence
  Description of Artificial Sequence: Synthetic oligonucleotide
  Target: FXN; (-) strand; PAM type: YTN; PAM sequence: TTA
aacatataattataacacat

SEQ ID NO: 29707 - DNA, 20 bp, Artificial Sequence
  Description of Artificial Sequence: Synthetic oligonucleotide
  Target: FXN; (-) strand; PAM type: YTN; PAM sequence: CTT
aaacatataattataacaca

SEQ ID NO: 29708 - DNA, 20 bp, Artificial Sequence
  Description of Artificial Sequence: Synthetic oligonucleotide
  Target: FXN; (-) strand; PAM type: YTN; PAM sequence: CTA
tcttaaacatataattataa

SEQ ID NO: 29709 - DNA, 20 bp, Artificial Sequence
  Description of Artificial Sequence: Synthetic oligonucleotide
  Target: FXN; (-) strand; PAM type: YTN; PAM sequence: TTG
aacaactatcttaaacatat

SEQ ID NO: 29710 - DNA, 20 bp, Artificial Sequence
  Description of Artificial Sequence: Synthetic oligonucleotide
  Target: FXN; (-) strand; PAM type: YTN; PAM sequence: TTT
gaacaactatcttaaacata

SEQ ID NO: 29711 - DNA, 20 bp, Artificial Sequence
  Description of Artificial Sequence: Synthetic oligonucleotide
  Target: FXN; (-) strand; PAM type: YTN; PAM sequence: TTA
tttgaacaactatcttaaac

SEQ ID NO: 29712 - DNA, 20 bp, Artificial Sequence
  Description of Artificial Sequence: Synthetic oligonucleotide
  Target: FXN; (-) strand; PAM type: YTN; PAM sequence: TTT
atttgaacaactatcttaaa

SEQ ID NO: 29713 - DNA, 20 bp, Artificial Sequence
  Description of Artificial Sequence: Synthetic oligonucleotide
  Target: FXN; (-) strand; PAM type: YTN; PAM sequence: TTA
gagtttatttgaacaactat

SEQ ID NO: 29714 - DNA, 20 bp, Artificial Sequence
  Description of Artificial Sequence: Synthetic oligonucleotide
  Target: FXN; (-) strand; PAM type: YTN; PAM sequence: TTT
agagtttatttgaacaacta

SEQ ID NO: 29715 - DNA, 20 bp, Artificial Sequence
  Description of Artificial Sequence: Synthetic oligonucleotide
  Target: FXN; (-) strand; PAM type: YTN; PAM sequence: TTA
tttagagtttatttgaacaa

SEQ ID NO: 29716 - DNA, 20 bp, Artificial Sequence
  Description of Artificial Sequence: Synthetic oligonucleotide
  Target: FXN; (-) strand; PAM type: YTN; PAM sequence: TTG
gggttatttagagtttattt

SEQ ID NO: 29717 - DNA, 20 bp, Artificial Sequence
  Description of Artificial Sequence: Synthetic oligonucleotide
  Target: FXN; (-) strand; PAM type: YTN; PAM sequence: TTG
gagttggggttatttagagt

SEQ ID NO: 29718 - DNA, 20 bp, Artificial Sequence
  Description of Artificial Sequence: Synthetic oligonucleotide
  Target: FXN; (-) strand; PAM type: YTN; PAM sequence: CTT
ggagttggggttatttagag

SEQ ID NO: 29719 - DNA, 20 bp, Artificial Sequence
  Description of Artificial Sequence: Synthetic oligonucleotide
  Target: FXN; (-) strand; PAM type: YTN; PAM sequence: CTC
ttggagttggggttatttag

SEQ ID NO: 29720 - DNA, 20 bp, Artificial Sequence
  Description of Artificial Sequence: Synthetic oligonucleotide
  Target: FXN; (-) strand; PAM type: YTN; PAM sequence: CTA
acactcttggagttggggtt

SEQ ID NO: 29721 - DNA, 20 bp, Artificial Sequence
  Description of Artificial Sequence: Synthetic oligonucleotide
  Target: FXN; (-) strand; PAM type: YTN; PAM sequence: TTG
ctaacactcttggagttggg

SEQ ID NO: 29722 - DNA, 20 bp, Artificial Sequence
  Description of Artificial Sequence: Synthetic oligonucleotide
  Target: FXN; (-) strand; PAM type: YTN; PAM sequence: CTT
gctaacactcttggagttgg

SEQ ID NO: 29723 - DNA, 20 bp, Artificial Sequence
  Description of Artificial Sequence: Synthetic oligonucleotide
  Target: FXN; (-) strand; PAM type: YTN; PAM sequence: TTC
ttgctaacactcttggagtt

SEQ ID NO: 29724 - DNA, 20 bp, Artificial Sequence
  Description of Artificial Sequence: Synthetic oligonucleotide
  Target: FXN; (-) strand; PAM type: YTN; PAM sequence: TTT
cttgctaacactcttggagt

SEQ ID NO: 29725 - DNA, 20 bp, Artificial Sequence
  Description of Artificial Sequence: Synthetic oligonucleotide
  Target: FXN; (-) strand; PAM type: YTN; PAM sequence: TTA
tatttcttgctaacactctt

SEQ ID NO: 29726 - DNA, 20 bp, Artificial Sequence
  Description of Artificial Sequence: Synthetic oligonucleotide
  Target: FXN; (-) strand; PAM type: YTN; PAM sequence: TTT
atatttcttgctaacactct

SEQ ID NO: 29727 - DNA, 20 bp, Artificial Sequence
  Description of Artificial Sequence: Synthetic oligonucleotide
  Target: FXN; (-) strand; PAM type: YTN; PAM sequence: CTG
taaaatttatatttcttgct

SEQ ID NO: 29728 - DNA, 20 bp, Artificial Sequence
  Description of Artificial Sequence: Synthetic oligonucleotide
  Target: FXN; (-) strand; PAM type: YTN; PAM sequence: TTC
tgtaaaatttatatttcttg

SEQ ID NO: 29729 - DNA, 20 bp, Artificial Sequence
  Description of Artificial Sequence: Synthetic oligonucleotide
  Target: FXN; (-) strand; PAM type: YTN; PAM sequence: CTT
ctgtaaaatttatatttctt

SEQ ID NO: 29730 - DNA, 20 bp, Artificial Sequence
  Description of Artificial Sequence: Synthetic oligonucleotide
  Target: FXN; (-) strand; PAM type: YTN; PAM sequence: TTC
ttctgtaaaatttatatttc

SEQ ID NO: 29731 - DNA, 20 bp, Artificial Sequence
  Description of Artificial Sequence: Synthetic oligonucleotide
  Target: FXN; (-) strand; PAM type: YTN; PAM sequence: CTC
caaccattcttctgtaaaat

SEQ ID NO: 29732 - DNA, 20 bp, Artificial Sequence
  Description of Artificial Sequence: Synthetic oligonucleotide
  Target: FXN; (-) strand; PAM type: YTN; PAM sequence: CTC
cccacctccaaccattcttc

SEQ ID NO: 29733 - DNA, 20 bp, Artificial Sequence
  Description of Artificial Sequence: Synthetic oligonucleotide
  Target: FXN; (-) strand; PAM type: YTN; PAM sequence: CTC
cgtggacaccctccccacct

SEQ ID NO: 29734 - DNA, 20 bp, Artificial Sequence
  Description of Artificial Sequence: Synthetic oligonucleotide
  Target: FXN; (-) strand; PAM type: YTN; PAM sequence: CTC
actccgtggacaccctcccc

SEQ ID NO: 29735 - DNA, 20 bp, Artificial Sequence
  Description of Artificial Sequence: Synthetic oligonucleotide
  Target: FXN; (-) strand; PAM type: YTN; PAM sequence: CTG
tgtgaggtaactcactccgt

SEQ ID NO: 29736 - DNA, 20 bp, Artificial Sequence
  Description of Artificial Sequence: Synthetic oligonucleotide
  Target: FXN; (-) strand; PAM type: YTN; PAM sequence: TTC
cgtgcctgtgtgaggtaact

SEQ ID NO: 29737 - DNA, 20 bp, Artificial Sequence
  Description of Artificial Sequence: Synthetic oligonucleotide
  Target: FXN; (-) strand; PAM type: YTN; PAM sequence: TTT
ccgtgcctgtgtgaggtaac

SEQ ID NO: 29738 - DNA, 20 bp, Artificial Sequence
  Description of Artificial Sequence: Synthetic oligonucleotide
  Target: FXN; (-) strand; PAM type: YTN; PAM sequence: TTT
tccgtgcctgtgtgaggtaa

SEQ ID NO: 29739 - DNA, 20 bp, Artificial Sequence
  Description of Artificial Sequence: Synthetic oligonucleotide
  Target: FXN; (-) strand; PAM type: YTN; PAM sequence: TTT
ttccgtgcctgtgtgaggta

SEQ ID NO: 29740 - DNA, 20 bp, Artificial Sequence
  Description of Artificial Sequence: Synthetic oligonucleotide
  Target: FXN; (-) strand; PAM type: YTN; PAM sequence: TTC
aagtttttccgtgcctgtgt

SEQ ID NO: 29741 - DNA, 20 bp, Artificial Sequence
  Description of Artificial Sequence: Synthetic oligonucleotide
  Target: FXN; (-) strand; PAM type: YTN; PAM sequence: TTA
ggaggttcaagtttttccgt

SEQ ID NO: 29742 - DNA, 20 bp, Artificial Sequence
  Description of Artificial Sequence: Synthetic oligonucleotide
  Target: FXN; (-) strand; PAM type: YTN; PAM sequence: CTT
aggaggttcaagtttttccg

SEQ ID NO: 29743 - DNA, 20 bp, Artificial Sequence
  Description of Artificial Sequence: Synthetic oligonucleotide
  Target: FXN; (-) strand; PAM type: YTN; PAM sequence: TTA
aaaatgtccttaggaggttc

SEQ ID NO: 29744 - DNA, 20 bp, Artificial Sequence
  Description of Artificial Sequence: Synthetic oligonucleotide
  Target: FXN; (-) strand; PAM type: YTN; PAM sequence: CTT
aaaaatgtccttaggaggtt

SEQ ID NO: 29745 - DNA, 20 bp, Artificial Sequence
  Description of Artificial Sequence: Synthetic oligonucleotide
  Target: FXN; (+) strand; PAM type: YTN; PAM sequence: TTC
ttgcttcaaagtgaaactat

SEQ ID NO: 29746 - DNA, 20 bp, Artificial Sequence
  Description of Artificial Sequence: Synthetic oligonucleotide
  Target: FXN; (+) strand; PAM type: YTN; PAM sequence: CTT
gcttcaaagtgaaactatac

SEQ ID NO: 29747 - DNA, 20 bp, Artificial Sequence
  Description of Artificial Sequence: Synthetic oligonucleotide
  Target: FXN; (+) strand; PAM type: YTN; PAM sequence: TTG
cttcaaagtgaaactataca

SEQ ID NO: 29748 - DNA, 20 bp, Artificial Sequence
  Description of Artificial Sequence: Synthetic oligonucleotide
  Target: FXN; (+) strand; PAM type: YTN; PAM sequence: CTT
caaagtgaaactatacacta

SEQ ID NO: 29749 - DNA, 20 bp, Artificial Sequence
  Description of Artificial Sequence: Synthetic oligonucleotide
  Target: FXN; (+) strand; PAM type: YTN; PAM sequence: TTC
aaagtgaaactatacactaa

SEQ ID NO: 29750 - DNA, 20 bp, Artificial Sequence
  Description of Artificial Sequence: Synthetic oligonucleotide
  Target: FXN; (+) strand; PAM type: YTN; PAM sequence: CTA
tacactaaattcctcccaca

SEQ ID NO: 29751 - DNA, 20 bp, Artificial Sequence
  Description of Artificial Sequence: Synthetic oligonucleotide
  Target: FXN; (+) strand; PAM type: YTN; PAM sequence: CTA
aattcctcccacagttagct

SEQ ID NO: 29752 - DNA, 20 bp, Artificial Sequence
  Description of Artificial Sequence: Synthetic oligonucleotide
  Target: FXN; (+) strand; PAM type: YTN; PAM sequence: TTC
ctcccacagttagcttggcg

SEQ ID NO: 29753 - DNA, 20 bp, Artificial Sequence
  Description of Artificial Sequence: Synthetic oligonucleotide
  Target: FXN; (+) strand; PAM type: YTN; PAM sequence: CTC
ccacagttagcttggcgtgg

SEQ ID NO: 29754 - DNA, 20 bp, Artificial Sequence
  Description of Artificial Sequence: Synthetic oligonucleotide
  Target: FXN; (+) strand; PAM type: YTN; PAM sequence: TTA
gcttggcgtggcctttgtta

SEQ ID NO: 29755 - DNA, 20 bp, Artificial Sequence
  Description of Artificial Sequence: Synthetic oligonucleotide
  Target: FXN; (+) strand; PAM type: YTN; PAM sequence: CTT
ggcgtggcctttgttatatg

SEQ ID NO: 29756 - DNA, 20 bp, Artificial Sequence
  Description of Artificial Sequence: Synthetic oligonucleotide
  Target: FXN; (+) strand; PAM type: YTN; PAM sequence: TTG
gcgtggcctttgttatatgc

SEQ ID NO: 29757 - DNA, 20 bp, Artificial Sequence
  Description of Artificial Sequence: Synthetic oligonucleotide
  Target: FXN; (+) strand; PAM type: YTN; PAM sequence: CTT
tgttatatgcccaggaataa

SEQ ID NO: 29758 - DNA, 20 bp, Artificial Sequence
  Description of Artificial Sequence: Synthetic oligonucleotide
  Target: FXN; (+) strand; PAM type: YTN; PAM sequence: TTT
gttatatgcccaggaataag

SEQ ID NO: 29759 - DNA, 20 bp, Artificial Sequence
  Description of Artificial Sequence: Synthetic oligonucleotide
  Target: FXN; (+) strand; PAM type: YTN; PAM sequence: TTG
ttatatgcccaggaataagt

SEQ ID NO: 29760 - DNA, 20 bp, Artificial Sequence
  Description of Artificial Sequence: Synthetic oligonucleotide
  Target: FXN; (+) strand; PAM type: YTN; PAM sequence: TTA
tatgcccaggaataagtgag

SEQ ID NO: 29761 - DNA, 20 bp, Artificial Sequence
  Description of Artificial Sequence: Synthetic oligonucleotide
  Target: FXN; (+) strand; PAM type: YTN; PAM sequence: CTA
tgagactagaagcaagatgg

SEQ ID NO: 29762 - DNA, 20 bp, Artificial Sequence
  Description of Artificial Sequence: Synthetic oligonucleotide
  Target: FXN; (+) strand; PAM type: YTN; PAM sequence: CTA
gaagcaagatggagtcagcc

SEQ ID NO: 29763 - DNA, 20 bp, Artificial Sequence
  Description of Artificial Sequence: Synthetic oligonucleotide
  Target: FXN; (+) strand; PAM type: YTN; PAM sequence: CTA
aatttctctcactgtcataa

SEQ ID NO: 29764 - DNA, 20 bp, Artificial Sequence
  Description of Artificial Sequence: Synthetic oligonucleotide
  Target: FXN; (+) strand; PAM type: YTN; PAM sequence: TTT
ctctcactgtcataaccttt

SEQ ID NO: 29765 - DNA, 20 bp, Artificial Sequence
  Description of Artificial Sequence: Synthetic oligonucleotide
  Target: FXN; (+) strand; PAM type: YTN; PAM sequence: TTC
tctcactgtcataaccttta

SEQ ID NO: 29766 - DNA, 20 bp, Artificial Sequence
  Description of Artificial Sequence: Synthetic oligonucleotide
  Target: FXN; (+) strand; PAM type: YTN; PAM sequence: CTC
tcactgtcataacctttaca

SEQ ID NO: 29767 - DNA, 20 bp, Artificial Sequence
  Description of Artificial Sequence: Synthetic oligonucleotide
  Target: FXN; (+) strand; PAM type: YTN; PAM sequence: CTC
actgtcataacctttacaaa

SEQ ID NO: 29768 - DNA, 20 bp, Artificial Sequence
  Description of Artificial Sequence: Synthetic oligonucleotide
  Target: FXN; (+) strand; PAM type: YTN; PAM sequence: CTG
tcataacctttacaaaggtg

SEQ ID NO: 29769 - DNA, 20 bp, Artificial Sequence
  Description of Artificial Sequence: Synthetic oligonucleotide
  Target: FXN; (+) strand; PAM type: YTN; PAM sequence: CTT
tacaaaggtggtttcattag

SEQ ID NO: 29770 - DNA, 20 bp, Artificial Sequence
  Description of Artificial Sequence: Synthetic oligonucleotide
  Target: FXN; (+) strand; PAM type: YTN; PAM sequence: TTT
acaaaggtggtttcattagg

SEQ ID NO: 29771 - DNA, 20 bp, Artificial Sequence
  Description of Artificial Sequence: Synthetic oligonucleotide
  Target: FXN; (+) strand; PAM type: YTN; PAM sequence: TTA
caaaggtggtttcattaggc

SEQ ID NO: 29772 - DNA, 20 bp, Artificial Sequence
  Description of Artificial Sequence: Synthetic oligonucleotide
  Target: FXN; (+) strand; PAM type: YTN; PAM sequence: TTT
cattaggcatattaatgcaa

SEQ ID NO: 29773 - DNA, 20 bp, Artificial Sequence
  Description of Artificial Sequence: Synthetic oligonucleotide
  Target: FXN; (+) strand; PAM type: YTN; PAM sequence: TTC
attaggcatattaatgcaaa

SEQ ID NO: 29774 - DNA, 20 bp, Artificial Sequence
  Description of Artificial Sequence: Synthetic oligonucleotide
  Target: FXN; (+) strand; PAM type: YTN; PAM sequence: TTA
ggcatattaatgcaaattcc

SEQ ID NO: 29775 - DNA, 20 bp, Artificial Sequence
  Description of Artificial Sequence: Synthetic oligonucleotide
  Target: FXN; (+) strand; PAM type: YTN; PAM sequence: TTA
atgcaaattccttagttaaa

SEQ ID NO: 29776 - DNA, 20 bp, Artificial Sequence
  Description of Artificial Sequence: Synthetic oligonucleotide
  Target: FXN; (+) strand; PAM type: YTN; PAM sequence: TTC
cttagttaaaacaagaatga

SEQ ID NO: 29777 - DNA, 20 bp, Artificial Sequence
  Description of Artificial Sequence: Synthetic oligonucleotide
  Target: FXN; (+) strand; PAM type: YTN; PAM sequence: CTT
agttaaaacaagaatgactc

SEQ ID NO: 29778 - DNA, 20 bp, Artificial Sequence
  Description of Artificial Sequence: Synthetic oligonucleotide
  Target: FXN; (+) strand; PAM type: YTN; PAM sequence: TTA
gttaaaacaagaatgactct

SEQ ID NO: 29779 - DNA, 20 bp, Artificial Sequence
  Description of Artificial Sequence: Synthetic oligonucleotide
  Target: FXN; (+) strand; PAM type: YTN; PAM sequence: TTA
aaacaagaatgactctctaa

SEQ ID NO: 29780 - DNA, 20 bp, Artificial Sequence
  Description of Artificial Sequence: Synthetic oligonucleotide
  Target: FXN; (+) strand; PAM type: YTN; PAM sequence: CTC
tctaaaggctatatttcaga

SEQ ID NO: 29781 - DNA, 20 bp, Artificial Sequence
  Description of Artificial Sequence: Synthetic oligonucleotide
  Target: FXN; (+) strand; PAM type: YTN; PAM sequence: CTC
taaaggctatatttcagata

SEQ ID NO: 29782 - DNA, 20 bp, Artificial Sequence
  Description of Artificial Sequence: Synthetic oligonucleotide
  Target: FXN; (+) strand; PAM type: YTN; PAM sequence: CTA
aaggctatatttcagataca

SEQ ID NO: 29783 - DNA, 20 bp, Artificial Sequence
  Description of Artificial Sequence: Synthetic oligonucleotide
  Target: FXN; (+) strand; PAM type: YTN; PAM sequence: CTA
tatttcagatacatcacatg

SEQ ID NO: 29784 - DNA, 20 bp, Artificial Sequence
  Description of Artificial Sequence: Synthetic oligonucleotide
  Target: FXN; (+) strand; PAM type: YTN; PAM sequence: TTT
cagatacatcacatgcttct

SEQ ID NO: 29785 - DNA, 20 bp, Artificial Sequence
  Description of Artificial Sequence: Synthetic oligonucleotide
  Target: FXN; (+) strand; PAM type: YTN; PAM sequence: TTC
agatacatcacatgcttctt

SEQ ID NO: 29786 - DNA, 20 bp, Artificial Sequence
  Description of Artificial Sequence: Synthetic oligonucleotide
  Target: FXN; (+) strand; PAM type: YTN; PAM sequence: CTT
ctttcctcttgtcccctcaa

SEQ ID NO: 29787 - DNA, 20 bp, Artificial Sequence
  Description of Artificial Sequence: Synthetic oligonucleotide
  Target: FXN; (+) strand; PAM type: YTN; PAM sequence: TTC
tttcctcttgtcccctcaac

SEQ ID NO: 29788 - DNA, 20 bp, Artificial Sequence
  Description of Artificial Sequence: Synthetic oligonucleotide
  Target: FXN; (+) strand; PAM type: YTN; PAM sequence: CTT
tcctcttgtcccctcaacag

SEQ ID NO: 29789 - DNA, 20 bp, Artificial Sequence
  Description of Artificial Sequence: Synthetic oligonucleotide
  Target: FXN; (+) strand; PAM type: YTN; PAM sequence: TTT
cctcttgtcccctcaacagt

SEQ ID NO: 29790 - DNA, 20 bp, Artificial Sequence
  Description of Artificial Sequence: Synthetic oligonucleotide
  Target: FXN; (+) strand; PAM type: YTN; PAM sequence: TTC
ctcttgtcccctcaacagta

SEQ ID NO: 29791 - DNA, 20 bp, Artificial Sequence
  Description of Artificial Sequence: Synthetic oligonucleotide
  Target: FXN; (+) strand; PAM type: YTN; PAM sequence: CTC
ttgtcccctcaacagtaagc

SEQ ID NO: 29792 - DNA, 20 bp, Artificial Sequence
  Description of Artificial Sequence: Synthetic oligonucleotide
  Target: FXN; (+) strand; PAM type: YTN; PAM sequence: CTT
gtcccctcaacagtaagcaa

SEQ ID NO: 29793 - DNA, 20 bp, Artificial Sequence
  Description of Artificial Sequence: Synthetic oligonucleotide
  Target: FXN; (+) strand; PAM type: YTN; PAM sequence: TTG
tcccctcaacagtaagcaag

SEQ ID NO: 29794 - DNA, 20 bp, Artificial Sequence
  Description of Artificial Sequence: Synthetic oligonucleotide
  Target: FXN; (+) strand; PAM type: YTN; PAM sequence: CTC
aacagtaagcaagaagagta

SEQ ID NO: 29795 - DNA, 20 bp, Artificial Sequence
  Description of Artificial Sequence: Synthetic oligonucleotide
  Target: FXN; (+) strand; PAM type: YTN; PAM sequence: TTT
ttgtacaagagagaggcctc

SEQ ID NO: 29796 - DNA, 20 bp, Artificial Sequence
  Description of Artificial Sequence: Synthetic oligonucleotide
  Target: FXN; (+) strand; PAM type: YTN; PAM sequence: TTT
tgtacaagagagaggcctct

SEQ ID NO: 29797 - DNA, 20 bp, Artificial Sequence
  Description of Artificial Sequence: Synthetic oligonucleotide
  Target: FXN; (+) strand; PAM type: YTN; PAM sequence: TTT
gtacaagagagaggcctctg

SEQ ID NO: 29798 - DNA, 20 bp, Artificial Sequence
  Description of Artificial Sequence: Synthetic oligonucleotide
  Target: FXN; (+) strand; PAM type: YTN; PAM sequence: TTG
tacaagagagaggcctctgc

SEQ ID NO: 29799 - DNA, 20 bp, Artificial Sequence
  Description of Artificial Sequence: Synthetic oligonucleotide
  Target: FXN; (+) strand; PAM type: YTN; PAM sequence: CTC
tgcctgaagctcccttaatc

SEQ ID NO: 29800 - DNA, 20 bp, Artificial Sequence
  Description of Artificial Sequence: Synthetic oligonucleotide
  Target: FXN; (+) strand; PAM type: YTN; PAM sequence: CTG
cctgaagctcccttaatctg

SEQ ID NO: 29801 - DNA, 20 bp, Artificial Sequence
  Description of Artificial Sequence: Synthetic oligonucleotide
  Target: FXN; (+) strand; PAM type: YTN; PAM sequence: CTG
aagctcccttaatctgtcag

SEQ ID NO: 29802 - DNA, 20 bp, Artificial Sequence
  Description of Artificial Sequence: Synthetic oligonucleotide
  Target: FXN; (+) strand; PAM type: YTN; PAM sequence: CTC
ccttaatctgtcagatcaca

SEQ ID NO: 29803 - DNA, 20 bp, Artificial Sequence
  Description of Artificial Sequence: Synthetic oligonucleotide
  Target: FXN; (+) strand; PAM type: YTN; PAM sequence: CTT
aatctgtcagatcacagatc

SEQ ID NO: 29804 - DNA, 20 bp, Artificial Sequence
  Description of Artificial Sequence: Synthetic oligonucleotide
  Target: FXN; (+) strand; PAM type: YTN; PAM sequence: TTA
atctgtcagatcacagatca

SEQ ID NO: 29805 - DNA, 20 bp, Artificial Sequence
  Description of Artificial Sequence: Synthetic oligonucleotide
  Target: FXN; (+) strand; PAM type: YTN; PAM sequence: CTG
tcagatcacagatcaaaagc

SEQ ID NO: 29806 - DNA, 20 bp, Artificial Sequence
  Description of Artificial Sequence: Synthetic oligonucleotide
  Target: FXN; (+) strand; PAM type: YTN; PAM sequence: CTA
tcacacactgcccaagggac

SEQ ID NO: 29807 - DNA, 20 bp, Artificial Sequence
  Description of Artificial Sequence: Synthetic oligonucleotide
  Target: FXN; (+) strand; PAM type: YTN; PAM sequence: CTG
cccaagggaccctaaaggga

SEQ ID NO: 29808 - DNA, 20 bp, Artificial Sequence
  Description of Artificial Sequence: Synthetic oligonucleotide
  Target: FXN; (+) strand; PAM type: YTN; PAM sequence: CTA
aagggagccactctcagaaa

SEQ ID NO: 29809 - DNA, 20 bp, Artificial Sequence
  Description of Artificial Sequence: Synthetic oligonucleotide
  Target: FXN; (+) strand; PAM type: YTN; PAM sequence: CTC
tcagaaaataaatccaaacc

SEQ ID NO: 29810 - DNA, 20 bp, Artificial Sequence
  Description of Artificial Sequence: Synthetic oligonucleotide
  Target: FXN; (+) strand; PAM type: YTN; PAM sequence: CTC
agaaaataaatccaaacctc

SEQ ID NO: 29811 - DNA, 20 bp, Artificial Sequence
  Description of Artificial Sequence: Synthetic oligonucleotide
  Target: FXN; (+) strand; PAM type: YTN; PAM sequence: CTC
cttttttctggccactgaaa

SEQ ID NO: 29812 - DNA, 20 bp, Artificial Sequence
  Description of Artificial Sequence: Synthetic oligonucleotide
  Target: FXN; (+) strand; PAM type: YTN; PAM sequence: CTT
ttttctggccactgaaacgt

SEQ ID NO: 29813 - DNA, 20 bp, Artificial Sequence
  Description of Artificial Sequence: Synthetic oligonucleotide
  Target: FXN; (+) strand; PAM type: YTN; PAM sequence: TTT
tttctggccactgaaacgtt

SEQ ID NO: 29814 - DNA, 20 bp, Artificial Sequence
  Description of Artificial Sequence: Synthetic oligonucleotide
  Target: FXN; (+) strand; PAM type: YTN; PAM sequence: TTT
ttctggccactgaaacgttc

SEQ ID NO: 29815 - DNA, 20 bp, Artificial Sequence
  Description of Artificial Sequence: Synthetic oligonucleotide
  Target: FXN; (+) strand; PAM type: YTN; PAM sequence: TTT
tctggccactgaaacgttca

SEQ ID NO: 29816 - DNA, 20 bp, Artificial Sequence
  Description of Artificial Sequence: Synthetic oligonucleotide
  Target: FXN; (+) strand; PAM type: YTN; PAM sequence: TTT
ctggccactgaaacgttcaa

SEQ ID NO: 29817 - DNA, 20 bp, Artificial Sequence
  Description of Artificial Sequence: Synthetic oligonucleotide
  Target: FXN; (+) strand; PAM type: YTN; PAM sequence: TTC
tggccactgaaacgttcaat

SEQ ID NO: 29818 - DNA, 20 bp, Artificial Sequence
  Description of Artificial Sequence: Synthetic oligonucleotide
  Target: FXN; (+) strand; PAM type: YTN; PAM sequence: CTG
gccactgaaacgttcaataa

SEQ ID NO: 29819 - DNA, 20 bp, Artificial Sequence
  Description of Artificial Sequence: Synthetic oligonucleotide
  Target: FXN; (+) strand; PAM type: YTN; PAM sequence: CTG
aaacgttcaataattagttc

SEQ ID NO: 29820 - DNA, 20 bp, Artificial Sequence
  Description of Artificial Sequence: Synthetic oligonucleotide
  Target: FXN; (+) strand; PAM type: YTN; PAM sequence: TTC
aataattagttcattatcta

SEQ ID NO: 29821 - DNA, 20 bp, Artificial Sequence
  Description of Artificial Sequence: Synthetic oligonucleotide
  Target: FXN; (+) strand; PAM type: YTN; PAM sequence: TTA
gttcattatctacatcattc

SEQ ID NO: 29822 - DNA, 20 bp, Artificial Sequence
  Description of Artificial Sequence: Synthetic oligonucleotide
  Target: FXN; (+) strand; PAM type: YTN; PAM sequence: TTC
attatctacatcattcacat

SEQ ID NO: 29823 - DNA, 20 bp, Artificial Sequence
  Description of Artificial Sequence: Synthetic oligonucleotide
  Target: FXN; (+) strand; PAM type: YTN; PAM sequence: TTA
tctacatcattcacatgttt

SEQ ID NO: 29824 - DNA, 20 bp, Artificial Sequence
  Description of Artificial Sequence: Synthetic oligonucleotide
  Target: FXN; (+) strand; PAM type: YTN; PAM sequence: CTA
catcattcacatgtttaata

SEQ ID NO: 29825 - DNA, 20 bp, Artificial Sequence
  Description of Artificial Sequence: Synthetic oligonucleotide
  Target: FXN; (+) strand; PAM type: YTN; PAM sequence: TTC
acatgtttaatatttattga

SEQ ID NO: 29826 - DNA, 20 bp, Artificial Sequence
  Description of Artificial Sequence: Synthetic oligonucleotide
  Target: FXN; (+) strand; PAM type: YTN; PAM sequence: TTT
aatatttattgactttggaa

SEQ ID NO: 29827 - DNA, 20 bp, Artificial Sequence
  Description of Artificial Sequence: Synthetic oligonucleotide
  Target: FXN; (+) strand; PAM type: YTN; PAM sequence: TTA
atatttattgactttggaat

SEQ ID NO: 29828 - DNA, 20 bp, Artificial Sequence
  Description of Artificial Sequence: Synthetic oligonucleotide
  Target: FXN; (+) strand; PAM type: YTN; PAM sequence: TTT
attgactttggaattattga

SEQ ID NO: 29829 - DNA, 20 bp, Artificial Sequence
  Description of Artificial Sequence: Synthetic oligonucleotide
  Target: FXN; (+) strand; PAM type: YTN; PAM sequence: TTA
ttgactttggaattattgat

SEQ ID NO: 29830 - DNA, 20 bp, Artificial Sequence
  Description of Artificial Sequence: Synthetic oligonucleotide
  Target: FXN; (+) strand; PAM type: YTN; PAM sequence: TTG
actttggaattattgattac

SEQ ID NO: 29831 - DNA, 20 bp, Artificial Sequence
  Description of Artificial Sequence: Synthetic oligonucleotide
  Target: FXN; (+) strand; PAM type: YTN; PAM sequence: CTT
tggaattattgattactttg

SEQ ID NO: 29832 - DNA, 20 bp, Artificial Sequence
  Description of Artificial Sequence: Synthetic oligonucleotide
  Target: FXN; (+) strand; PAM type: YTN; PAM sequence: TTT
ggaattattgattactttgc

SEQ ID NO: 29833 - DNA, 20 bp, Artificial Sequence
  Description of Artificial Sequence: Synthetic oligonucleotide
  Target: FXN; (+) strand; PAM type: YTN; PAM sequence: TTG
gaattattgattactttgct

SEQ ID NO: 29834 - DNA, 20 bp, Artificial Sequence
  Description of Artificial Sequence: Synthetic oligonucleotide
  Target: FXN; (+) strand; PAM type: YTN; PAM sequence: TTA
ttgattactttgctgagtat

SEQ ID NO: 29835 - DNA, 20 bp, Artificial Sequence
  Description of Artificial Sequence: Synthetic oligonucleotide
  Target: FXN; (+) strand; PAM type: YTN; PAM sequence: TTG
attactttgctgagtatctt

SEQ ID NO: 29836 - DNA, 20 bp, Artificial Sequence
  Description of Artificial Sequence: Synthetic oligonucleotide
  Target: FXN; (+) strand; PAM type: YTN; PAM sequence: TTA
ctttgctgagtatcttatga

SEQ ID NO: 29837 - DNA, 20 bp, Artificial Sequence
  Description of Artificial Sequence: Synthetic oligonucleotide
  Target: FXN; (+) strand; PAM type: YTN; PAM sequence: CTT
tgctgagtatcttatgaatt

SEQ ID NO: 29838 - DNA, 20 bp, Artificial Sequence
  Description of Artificial Sequence: Synthetic oligonucleotide
  Target: FXN; (+) strand; PAM type: YTN; PAM sequence: TTT
gctgagtatcttatgaattt

SEQ ID NO: 29839 - DNA, 20 bp, Artificial Sequence
  Description of Artificial Sequence: Synthetic oligonucleotide
  Target: FXN; (+) strand; PAM type: YTN; PAM sequence: TTG
ctgagtatcttatgaattta

SEQ ID NO: 29840 - DNA, 20 bp, Artificial Sequence
  Description of Artificial Sequence: Synthetic oligonucleotide
  Target: FXN; (+) strand; PAM type: YTN; PAM sequence: CTG
agtatcttatgaatttaatc

SEQ ID NO: 29841 - DNA, 20 bp, Artificial Sequence
  Description of Artificial Sequence: Synthetic oligonucleotide
  Target: FXN; (+) strand; PAM type: YTN; PAM sequence: CTT
atgaatttaatctatattaa

SEQ ID NO: 29842 - DNA, 20 bp, Artificial Sequence
  Description of Artificial Sequence: Synthetic oligonucleotide
  Target: FXN; (+) strand; PAM type: YTN; PAM sequence: TTA
tgaatttaatctatattaat

SEQ ID NO: 29843 - DNA, 20 bp, Artificial Sequence
  Description of Artificial Sequence: Synthetic oligonucleotide
  Target: FXN; (+) strand; PAM type: YTN; PAM sequence: TTT
aatctatattaatattaagg

SEQ ID NO: 29844 - DNA, 20 bp, Artificial Sequence
  Description of Artificial Sequence: Synthetic oligonucleotide
  Target: FXN; (+) strand; PAM type: YTN; PAM sequence: TTA
atctatattaatattaaggt

SEQ ID NO: 29845 - DNA, 20 bp, Artificial Sequence
  Description of Artificial Sequence: Synthetic oligonucleotide
  Target: FXN; (+) strand; PAM type: YTN; PAM sequence: CTA
tattaatattaaggtgatgt

SEQ ID NO: 29846 - DNA, 20 bp, Artificial Sequence
  Description of Artificial Sequence: Synthetic oligonucleotide
  Target: FXN; (+) strand; PAM type: YTN; PAM sequence: TTA
atattaaggtgatgtatcaa

SEQ ID NO: 29847 - DNA, 20 bp, Artificial Sequence
  Description of Artificial Sequence: Synthetic oligonucleotide
  Target: FXN; (+) strand; PAM type: YTN; PAM sequence: TTA
aggtgatgtatcaaattgca

SEQ ID NO: 29848 - DNA, 20 bp, Artificial Sequence
  Description of Artificial Sequence: Synthetic oligonucleotide
  Target: FXN; (+) strand; PAM type: YTN; PAM sequence: TTG
cattccagagtgtggatttg

SEQ ID NO: 29849 - DNA, 20 bp, Artificial Sequence
  Description of Artificial Sequence: Synthetic oligonucleotide
  Target: FXN; (+) strand; PAM type: YTN; PAM sequence: TTC
cagagtgtggatttgactct

SEQ ID NO: 29850 - DNA, 20 bp, Artificial Sequence
  Description of Artificial Sequence: Synthetic oligonucleotide
  Target: FXN; (+) strand; PAM type: YTN; PAM sequence: TTT
gactctagtgccataatcag

SEQ ID NO: 29851 - DNA, 20 bp, Artificial Sequence
  Description of Artificial Sequence: Synthetic oligonucleotide
  Target: FXN; (+) strand; PAM type: YTN; PAM sequence: TTG
actctagtgccataatcagt

SEQ ID NO: 29852 - DNA, 20 bp, Artificial Sequence
  Description of Artificial Sequence: Synthetic oligonucleotide
  Target: FXN; (+) strand; PAM type: YTN; PAM sequence: CTC
tagtgccataatcagtctcc

SEQ ID NO: 29853 - DNA, 20 bp, Artificial Sequence
  Description of Artificial Sequence: Synthetic oligonucleotide
  Target: FXN; (+) strand; PAM type: YTN; PAM sequence: CTA
gtgccataatcagtctcctg

SEQ ID NO: 29854 - DNA, 20 bp, Artificial Sequence
  Description of Artificial Sequence: Synthetic oligonucleotide
  Target: FXN; (+) strand; PAM type: YTN; PAM sequence: CTC
ctgggacaaacagctgtttc

SEQ ID NO: 29855 - DNA, 20 bp, Artificial Sequence
  Description of Artificial Sequence: Synthetic oligonucleotide
  Target: FXN; (+) strand; PAM type: YTN; PAM sequence: CTG
ggacaaacagctgtttctct

SEQ ID NO: 29856 - DNA, 20 bp, Artificial Sequence
  Description of Artificial Sequence: Synthetic oligonucleotide
  Target: FXN; (+) strand; PAM type: YTN; PAM sequence: CTG
tttctcttccctcattatag

SEQ ID NO: 29857 - DNA, 20 bp, Artificial Sequence
  Description of Artificial Sequence: Synthetic oligonucleotide
  Target: FXN; (+) strand; PAM type: YTN; PAM sequence: TTT
ctcttccctcattatagaaa

SEQ ID NO: 29858 - DNA, 20 bp, Artificial Sequence
  Description of Artificial Sequence: Synthetic oligonucleotide
  Target: FXN; (+) strand; PAM type: YTN; PAM sequence: TTC
tcttccctcattatagaaaa

SEQ ID NO: 29859 - DNA, 20 bp, Artificial Sequence
  Description of Artificial Sequence: Synthetic oligonucleotide
  Target: FXN; (+) strand; PAM type: YTN; PAM sequence: CTC
ttccctcattatagaaaaaa

SEQ ID NO: 29860 - DNA, 20 bp, Artificial Sequence
  Description of Artificial Sequence: Synthetic oligonucleotide
  Target: FXN; (+) strand; PAM type: YTN; PAM sequence: CTT
ccctcattatagaaaaaaat

SEQ ID NO: 29861 - DNA, 20 bp, Artificial Sequence
  Description of Artificial Sequence: Synthetic oligonucleotide
  Target: FXN; (+) strand; PAM type: YTN; PAM sequence: TTC
cctcattatagaaaaaaatt

SEQ ID NO: 29862 - DNA, 20 bp, Artificial Sequence
  Description of Artificial Sequence: Synthetic oligonucleotide
  Target: FXN; (+) strand; PAM type: YTN; PAM sequence: CTC
attatagaaaaaaattgccc

SEQ ID NO: 29863 - DNA, 20 bp, Artificial Sequence
  Description of Artificial Sequence: Synthetic oligonucleotide
  Target: FXN; (+) strand; PAM type: YTN; PAM sequence: TTA
tagaaaaaaattgcccttgg

SEQ ID NO: 29864 - DNA, 20 bp, Artificial Sequence
  Description of Artificial Sequence: Synthetic oligonucleotide
  Target: FXN; (+) strand; PAM type: YTN; PAM sequence: TTG
cccttggcaaatgtcaaaga

SEQ ID NO: 29865 - DNA, 20 bp, Artificial Sequence
  Description of Artificial Sequence: Synthetic oligonucleotide
  Target: FXN; (+) strand; PAM type: YTN; PAM sequence: CTT
ggcaaatgtcaaagaacatc

SEQ ID NO: 29866 - DNA, 20 bp, Artificial Sequence
  Description of Artificial Sequence: Synthetic oligonucleotide
  Target: FXN; (+) strand; PAM type: YTN; PAM sequence: TTG
gcaaatgtcaaagaacatcc

SEQ ID NO: 29867 - DNA, 20 bp, Artificial Sequence
  Description of Artificial Sequence: Synthetic oligonucleotide
  Target: FXN; (+) strand; PAM type: YTN; PAM sequence: CTT
ttatcaatctctcttaccaa

SEQ ID NO: 29868 - DNA, 20 bp, Artificial Sequence
  Description of Artificial Sequence: Synthetic oligonucleotide
  Target: FXN; (+) strand; PAM type: YTN; PAM sequence: TTT
tatcaatctctcttaccaat

SEQ ID NO: 29869 - DNA, 20 bp, Artificial Sequence
  Description of Artificial Sequence: Synthetic oligonucleotide
  Target: FXN; (+) strand; PAM type: YTN; PAM sequence: TTT
atcaatctctcttaccaatc

SEQ ID NO: 29870 - DNA, 20 bp, Artificial Sequence
  Description of Artificial Sequence: Synthetic oligonucleotide
  Target: FXN; (+) strand; PAM type: YTN; PAM sequence: TTA
tcaatctctcttaccaatca

SEQ ID NO: 29871 - DNA, 20 bp, Artificial Sequence
  Description of Artificial Sequence: Synthetic oligonucleotide
  Target: FXN; (+) strand; PAM type: YTN; PAM sequence: CTC
tcttaccaatcaatccaagc

SEQ ID NO: 29872 - DNA, 20 bp, Artificial Sequence
  Description of Artificial Sequence: Synthetic oligonucleotide
  Target: FXN; (+) strand; PAM type: YTN; PAM sequence: CTC
ttaccaatcaatccaagcaa

SEQ ID NO: 29873 - DNA, 20 bp, Artificial Sequence
  Description of Artificial Sequence: Synthetic oligonucleotide
  Target: FXN; (+) strand; PAM type: YTN; PAM sequence: CTT
accaatcaatccaagcaaat

SEQ ID NO: 29874 - DNA, 20 bp, Artificial Sequence
  Description of Artificial Sequence: Synthetic oligonucleotide
  Target: FXN; (+) strand; PAM type: YTN; PAM sequence: TTA
ccaatcaatccaagcaaatg

SEQ ID NO: 29875 - DNA, 20 bp, Artificial Sequence
  Description of Artificial Sequence: Synthetic oligonucleotide
  Target: FXN; (+) strand; PAM type: YTN; PAM sequence: TTT
cttttccccagagttgaagt

SEQ ID NO: 29876 - DNA, 20 bp, Artificial Sequence
  Description of Artificial Sequence: Synthetic oligonucleotide
  Target: FXN; (+) strand; PAM type: YTN; PAM sequence: TTC
ttttccccagagttgaagtc

SEQ ID NO: 29877 - DNA, 20 bp, Artificial Sequence
  Description of Artificial Sequence: Synthetic oligonucleotide
  Target: FXN; (+) strand; PAM type: YTN; PAM sequence: CTT
ttccccagagttgaagtcac

SEQ ID NO: 29878 - DNA, 20 bp, Artificial Sequence
  Description of Artificial Sequence: Synthetic oligonucleotide
  Target: FXN; (+) strand; PAM type: YTN; PAM sequence: TTT
tccccagagttgaagtcacc

SEQ ID NO: 29879 - DNA, 20 bp, Artificial Sequence
  Description of Artificial Sequence: Synthetic oligonucleotide
  Target: FXN; (+) strand; PAM type: YTN; PAM sequence: TTT
ccccagagttgaagtcacct

SEQ ID NO: 29880 - DNA, 20 bp, Artificial Sequence
  Description of Artificial Sequence: Synthetic oligonucleotide
  Target: FXN; (+) strand; PAM type: YTN; PAM sequence: TTC
cccagagttgaagtcacctc

SEQ ID NO: 29881 - DNA, 20 bp, Artificial Sequence
  Description of Artificial Sequence: Synthetic oligonucleotide
  Target: FXN; (+) strand; PAM type: YTN; PAM sequence: TTG
aagtcacctcctgacaggaa

SEQ ID NO: 29882 - DNA, 20 bp, Artificial Sequence
  Description of Artificial Sequence: Synthetic oligonucleotide
  Target: FXN; (+) strand; PAM type: YTN; PAM sequence: CTC
ctgacaggaagttaagtctt

SEQ ID NO: 29883 - DNA, 20 bp, Artificial Sequence
  Description of Artificial Sequence: Synthetic oligonucleotide
  Target: FXN; (+) strand; PAM type: YTN; PAM sequence: CTG
acaggaagttaagtctttag

SEQ ID NO: 29884 - DNA, 20 bp, Artificial Sequence
  Description of Artificial Sequence: Synthetic oligonucleotide
  Target: FXN; (+) strand; PAM type: YTN; PAM sequence: TTA
agtctttaggcactgaatca

SEQ ID NO: 29885 - DNA, 20 bp, Artificial Sequence
  Description of Artificial Sequence: Synthetic oligonucleotide
  Target: FXN; (+) strand; PAM type: YTN; PAM sequence: CTT
taggcactgaatcatagcac

SEQ ID NO: 29886 - DNA, 20 bp, Artificial Sequence
  Description of Artificial Sequence: Synthetic oligonucleotide
  Target: FXN; (+) strand; PAM type: YTN; PAM sequence: TTT
aggcactgaatcatagcact

SEQ ID NO: 29887 - DNA, 20 bp, Artificial Sequence
  Description of Artificial Sequence: Synthetic oligonucleotide
  Target: FXN; (+) strand; PAM type: YTN; PAM sequence: TTA
ggcactgaatcatagcactg

SEQ ID NO: 29888 - DNA, 20 bp, Artificial Sequence
  Description of Artificial Sequence: Synthetic oligonucleotide
  Target: FXN; (+) strand; PAM type: YTN; PAM sequence: CTG
aatcatagcactgagctgaa

SEQ ID NO: 29889 - DNA, 20 bp, Artificial Sequence
  Description of Artificial Sequence: Synthetic oligonucleotide
  Target: FXN; (+) strand; PAM type: YTN; PAM sequence: CTG
agctgaagcccaggactaag

SEQ ID NO: 29890 - DNA, 20 bp, Artificial Sequence
  Description of Artificial Sequence: Synthetic oligonucleotide
  Target: FXN; (+) strand; PAM type: YTN; PAM sequence: CTG
aagcccaggactaagcaaga

SEQ ID NO: 29891 - DNA, 20 bp, Artificial Sequence
  Description of Artificial Sequence: Synthetic oligonucleotide
  Target: FXN; (+) strand; PAM type: YTN; PAM sequence: CTA
agcaagaatgagtgagaatt

SEQ ID NO: 29892 - DNA, 20 bp, Artificial Sequence
  Description of Artificial Sequence: Synthetic oligonucleotide
  Target: FXN; (+) strand; PAM type: YTN; PAM sequence: TTT
ggagacttaaggtttggtca

SEQ ID NO: 29893 - DNA, 20 bp, Artificial Sequence
  Description of Artificial Sequence: Synthetic oligonucleotide
  Target: FXN; (+) strand; PAM type: YTN; PAM sequence: TTG
gagacttaaggtttggtcat

SEQ ID NO: 29894 - DNA, 20 bp, Artificial Sequence
  Description of Artificial Sequence: Synthetic oligonucleotide
  Target: FXN; (+) strand; PAM type: YTN; PAM sequence: CTT
aaggtttggtcatctgtaga

SEQ ID NO: 29895 - DNA, 20 bp, Artificial Sequence
  Description of Artificial Sequence: Synthetic oligonucleotide
  Target: FXN; (+) strand; PAM type: YTN; PAM sequence: TTA
aggtttggtcatctgtagag

SEQ ID NO: 29896 - DNA, 20 bp, Artificial Sequence
  Description of Artificial Sequence: Synthetic oligonucleotide
  Target: FXN; (+) strand; PAM type: YTN; PAM sequence: TTT
ggtcatctgtagaggattgg

SEQ ID NO: 29897 - DNA, 20 bp, Artificial Sequence
  Description of Artificial Sequence: Synthetic oligonucleotide
  Target: FXN; (+) strand; PAM type: YTN; PAM sequence: TTG
gtcatctgtagaggattggg

SEQ ID NO: 29898 - DNA, 20 bp, Artificial Sequence
  Description of Artificial Sequence: Synthetic oligonucleotide
  Target: FXN; (+) strand; PAM type: YTN; PAM sequence: CTG
tagaggattgggttttgtct

SEQ ID NO: 29899 - DNA, 20 bp, Artificial Sequence
  Description of Artificial Sequence: Synthetic oligonucleotide
  Target: FXN; (+) strand; PAM type: YTN; PAM sequence: TTG
ggttttgtcttgttttgttt

SEQ ID NO: 29900 - DNA, 20 bp, Artificial Sequence
  Description of Artificial Sequence: Synthetic oligonucleotide
  Target: FXN; (+) strand; PAM type: YTN; PAM sequence: TTT
tgtcttgttttgtttttgtt

SEQ ID NO: 29901 - DNA, 20 bp, Artificial Sequence
  Description of Artificial Sequence: Synthetic oligonucleotide
  Target: FXN; (+) strand; PAM type: YTN; PAM sequence: TTT
gtcttgttttgtttttgttt

SEQ ID NO: 29902 - DNA, 20 bp, Artificial Sequence
  Description of Artificial Sequence: Synthetic oligonucleotide
  Target: FXN; (+) strand; PAM type: YTN; PAM sequence: TTG
tcttgttttgtttttgtttt

SEQ ID NO: 29903 - DNA, 20 bp, Artificial Sequence
  Description of Artificial Sequence: Synthetic oligonucleotide
  Target: FXN; (+) strand; PAM type: YTN; PAM sequence: CTT
gttttgtttttgttttggtg

SEQ ID NO: 29904 - DNA, 20 bp, Artificial Sequence
  Description of Artificial Sequence: Synthetic oligonucleotide
  Target: FXN; (+) strand; PAM type: YTN; PAM sequence: TTG
ttttgtttttgttttggtgt

SEQ ID NO: 29905 - DNA, 20 bp, Artificial Sequence
  Description of Artificial Sequence: Synthetic oligonucleotide
  Target: FXN; (+) strand; PAM type: YTN; PAM sequence: TTT
tgtttttgttttggtgtcct

SEQ ID NO: 29906 - DNA, 20 bp, Artificial Sequence
  Description of Artificial Sequence: Synthetic oligonucleotide
  Target: FXN; (+) strand; PAM type: YTN; PAM sequence: TTT
gtttttgttttggtgtcctg

SEQ ID NO: 29907 - DNA, 20 bp, Artificial Sequence
  Description of Artificial Sequence: Synthetic oligonucleotide
  Target: FXN; (+) strand; PAM type: YTN; PAM sequence: TTG
tttttgttttggtgtcctgc

SEQ ID NO: 29908 - DNA, 20 bp, Artificial Sequence
  Description of Artificial Sequence: Synthetic oligonucleotide
  Target: FXN; (+) strand; PAM type: YTN; PAM sequence: TTT
ttgttttggtgtcctgcaag

SEQ ID NO: 29909 - DNA, 20 bp, Artificial Sequence
  Description of Artificial Sequence: Synthetic oligonucleotide
  Target: FXN; (+) strand; PAM type: YTN; PAM sequence: TTT
tgttttggtgtcctgcaagg

SEQ ID NO: 29910 - DNA, 20 bp, Artificial Sequence
  Description of Artificial Sequence: Synthetic oligonucleotide
  Target: FXN; (+) strand; PAM type: YTN; PAM sequence: TTT
gttttggtgtcctgcaaggt

SEQ ID NO: 29911 - DNA, 20 bp, Artificial Sequence
  Description of Artificial Sequence: Synthetic oligonucleotide
  Target: FXN; (+) strand; PAM type: YTN; PAM sequence: TTG
ttttggtgtcctgcaaggtt

SEQ ID NO: 29912 - DNA, 20 bp, Artificial Sequence
  Description of Artificial Sequence: Synthetic oligonucleotide
  Target: FXN; (+) strand; PAM type: YTN; PAM sequence: TTT
tggtgtcctgcaaggtttct

SEQ ID NO: 29913 - DNA, 20 bp, Artificial Sequence
  Description of Artificial Sequence: Synthetic oligonucleotide
  Target: FXN; (+) strand; PAM type: YTN; PAM sequence: TTT
ggtgtcctgcaaggtttctc

SEQ ID NO: 29914 - DNA, 20 bp, Artificial Sequence
  Description of Artificial Sequence: Synthetic oligonucleotide
  Target: FXN; (+) strand; PAM type: YTN; PAM sequence: TTG
gtgtcctgcaaggtttctca

SEQ ID NO: 29915 - DNA, 20 bp, Artificial Sequence
  Description of Artificial Sequence: Synthetic oligonucleotide
  Target: FXN; (+) strand; PAM type: YTN; PAM sequence: CTG
caaggtttctcactgccctt

SEQ ID NO: 29916 - DNA, 20 bp, Artificial Sequence
  Description of Artificial Sequence: Synthetic oligonucleotide
  Target: FXN; (+) strand; PAM type: YTN; PAM sequence: TTT
ctcactgcccttcatcaggt

SEQ ID NO: 29917 - DNA, 20 bp, Artificial Sequence
  Description of Artificial Sequence: Synthetic oligonucleotide
  Target: FXN; (+) strand; PAM type: YTN; PAM sequence: TTC
tcactgcccttcatcaggta

SEQ ID NO: 29918 - DNA, 20 bp, Artificial Sequence
  Description of Artificial Sequence: Synthetic oligonucleotide
  Target: FXN; (+) strand; PAM type: YTN; PAM sequence: CTC
actgcccttcatcaggtaat

SEQ ID NO: 29919 - DNA, 20 bp, Artificial Sequence
  Description of Artificial Sequence: Synthetic oligonucleotide
  Target: FXN; (+) strand; PAM type: YTN; PAM sequence: CTG
cccttcatcaggtaatatgc

SEQ ID NO: 29920 - DNA, 20 bp, Artificial Sequence
  Description of Artificial Sequence: Synthetic oligonucleotide
  Target: FXN; (+) strand; PAM type: YTN; PAM sequence: CTT
catcaggtaatatgccctgt

SEQ ID NO: 29921 - DNA, 20 bp, Artificial Sequence
  Description of Artificial Sequence: Synthetic oligonucleotide
  Target: FXN; (+) strand; PAM type: YTN; PAM sequence: TTC
atcaggtaatatgccctgtc

SEQ ID NO: 29922 - DNA, 20 bp, Artificial Sequence
  Description of Artificial Sequence: Synthetic oligonucleotide
  Target: FXN; (+) strand; PAM type: YTN; PAM sequence: CTG
tccctgaactggccaattgt

SEQ ID NO: 29923 - DNA, 20 bp, Artificial Sequence
  Description of Artificial Sequence: Synthetic oligonucleotide
  Target: FXN; (+) strand; PAM type: YTN; PAM sequence: CTG
aactggccaattgtgttacc

SEQ ID NO: 29924 - DNA, 20 bp, Artificial Sequence
  Description of Artificial Sequence: Synthetic oligonucleotide
  Target: FXN; (+) strand; PAM type: YTN; PAM sequence: CTG
gccaattgtgttaccccatt

SEQ ID NO: 29925 - DNA, 20 bp, Artificial Sequence
  Description of Artificial Sequence: Synthetic oligonucleotide
  Target: FXN; (+) strand; PAM type: YTN; PAM sequence: TTG
tgttaccccattcccttagc

SEQ ID NO: 29926 - DNA, 20 bp, Artificial Sequence
  Description of Artificial Sequence: Synthetic oligonucleotide
  Target: FXN; (+) strand; PAM type: YTN; PAM sequence: TTA
ccccattcccttagcaacag

SEQ ID NO: 29927 - DNA, 20 bp, Artificial Sequence
  Description of Artificial Sequence: Synthetic oligonucleotide
  Target: FXN; (+) strand; PAM type: YTN; PAM sequence: TTC
ccttagcaacagtgattgct

SEQ ID NO: 29928 - DNA, 20 bp, Artificial Sequence
  Description of Artificial Sequence: Synthetic oligonucleotide
  Target: FXN; (+) strand; PAM type: YTN; PAM sequence: CTT
agcaacagtgattgctactg

SEQ ID NO: 29929 - DNA, 20 bp, Artificial Sequence
  Description of Artificial Sequence: Synthetic oligonucleotide
  Target: FXN; (+) strand; PAM type: YTN; PAM sequence: TTA
gcaacagtgattgctactga

SEQ ID NO: 29930 - DNA, 20 bp, Artificial Sequence
  Description of Artificial Sequence: Synthetic oligonucleotide
  Target: FXN; (+) strand; PAM type: YTN; PAM sequence: TTG
ctactgaagaaacaggaggc

SEQ ID NO: 29931 - DNA, 20 bp, Artificial Sequence
  Description of Artificial Sequence: Synthetic oligonucleotide
  Target: FXN; (+) strand; PAM type: YTN; PAM sequence: CTA
ctgaagaaacaggaggccaa

SEQ ID NO: 29932 - DNA, 20 bp, Artificial Sequence
  Description of Artificial Sequence: Synthetic oligonucleotide
  Target: FXN; (+) strand; PAM type: YTN; PAM sequence: CTG
aagaaacaggaggccaacaa

SEQ ID NO: 29933 - DNA, 20 bp, Artificial Sequence
  Description of Artificial Sequence: Synthetic oligonucleotide
  Target: FXN; (+) strand; PAM type: YTN; PAM sequence: CTC
attcaccagtagagtgtcta

SEQ ID NO: 29934 - DNA, 20 bp, Artificial Sequence
  Description of Artificial Sequence: Synthetic oligonucleotide
  Target: FXN; (+) strand; PAM type: YTN; PAM sequence: TTC
accagtagagtgtctatgtc

SEQ ID NO: 29935 - DNA, 20 bp, Artificial Sequence
  Description of Artificial Sequence: Synthetic oligonucleotide
  Target: FXN; (+) strand; PAM type: YTN; PAM sequence: CTA
tgtcagagatattagataaa

SEQ ID NO: 29936 - DNA, 20 bp, Artificial Sequence
  Description of Artificial Sequence: Synthetic oligonucleotide
  Target: FXN; (+) strand; PAM type: YTN; PAM sequence: TTA
gataaacaggaaaactaaca

SEQ ID NO: 29937 - DNA, 20 bp, Artificial Sequence
  Description of Artificial Sequence: Synthetic oligonucleotide
  Target: FXN; (+) strand; PAM type: YTN; PAM sequence: CTA
acaattacattgcaggctgt

SEQ ID NO: 29938 - DNA, 20 bp, Artificial Sequence
  Description of Artificial Sequence: Synthetic oligonucleotide
  Target: FXN; (+) strand; PAM type: YTN; PAM sequence: TTA
cattgcaggctgtggaaaca

SEQ ID NO: 29939 - DNA, 20 bp, Artificial Sequence
  Description of Artificial Sequence: Synthetic oligonucleotide
  Target: FXN; (+) strand; PAM type: YTN; PAM sequence: TTG
caggctgtggaaacagagag

SEQ ID NO: 29940 - DNA, 20 bp, Artificial Sequence
  Description of Artificial Sequence: Synthetic oligonucleotide
  Target: FXN; (+) strand; PAM type: YTN; PAM sequence: CTG
tggaaacagagagaggtacc

SEQ ID NO: 29941 - DNA, 20 bp, Artificial Sequence
  Description of Artificial Sequence: Synthetic oligonucleotide
  Target: FXN; (+) strand; PAM type: YTN; PAM sequence: CTA
aggcacacctgtgggaatat

SEQ ID NO: 29942 - DNA, 20 bp, Artificial Sequence
  Description of Artificial Sequence: Synthetic oligonucleotide
  Target: FXN; (+) strand; PAM type: YTN; PAM sequence: CTG
tgggaatatgaaagtttggt

SEQ ID NO: 29943 - DNA, 20 bp, Artificial Sequence
  Description of Artificial Sequence: Synthetic oligonucleotide
  Target: FXN; (+) strand; PAM type: YTN; PAM sequence: TTT
ggtttcataaaaggattctg

SEQ ID NO: 29944 - DNA, 20 bp, Artificial Sequence
  Description of Artificial Sequence: Synthetic oligonucleotide
  Target: FXN; (+) strand; PAM type: YTN; PAM sequence: TTG
gtttcataaaaggattctgg

SEQ ID NO: 29945 - DNA, 20 bp, Artificial Sequence
  Description of Artificial Sequence: Synthetic oligonucleotide
  Target: FXN; (+) strand; PAM type: YTN; PAM sequence: TTT
cataaaaggattctggagga

SEQ ID NO: 29946 - DNA, 20 bp, Artificial Sequence
  Description of Artificial Sequence: Synthetic oligonucleotide
  Target: FXN; (+) strand; PAM type: YTN; PAM sequence: TTC
ataaaaggattctggaggaa

SEQ ID NO: 29947 - DNA, 20 bp, Artificial Sequence
  Description of Artificial Sequence: Synthetic oligonucleotide
  Target: FXN; (+) strand; PAM type: YTN; PAM sequence: TTC
tggaggaagtcacctctgac

SEQ ID NO: 29948 - DNA, 20 bp, Artificial Sequence
  Description of Artificial Sequence: Synthetic oligonucleotide
  Target: FXN; (+) strand; PAM type: YTN; PAM sequence: CTG
gaggaagtcacctctgacat

SEQ ID NO: 29949 - DNA, 20 bp, Artificial Sequence
  Description of Artificial Sequence: Synthetic oligonucleotide
  Target: FXN; (+) strand; PAM type: YTN; PAM sequence: CTC
tgacatttgagttgagtcct

SEQ ID NO: 29950 - DNA, 20 bp, Artificial Sequence
  Description of Artificial Sequence: Synthetic oligonucleotide
  Target: FXN; (+) strand; PAM type: YTN; PAM sequence: CTG
acatttgagttgagtcctac

SEQ ID NO: 29951 - DNA, 20 bp, Artificial Sequence
  Description of Artificial Sequence: Synthetic oligonucleotide
  Target: FXN; (+) strand; PAM type: YTN; PAM sequence: TTT
gagttgagtcctacaggata

SEQ ID NO: 29952 - DNA, 20 bp, Artificial Sequence
  Description of Artificial Sequence: Synthetic oligonucleotide
  Target: FXN; (+) strand; PAM type: YTN; PAM sequence: TTG
agttgagtcctacaggatat

SEQ ID NO: 29953 - DNA, 20 bp, Artificial Sequence
  Description of Artificial Sequence: Synthetic oligonucleotide
  Target: FXN; (+) strand; PAM type: YTN; PAM sequence: TTG
agtcctacaggatatgaaga

SEQ ID NO: 29954 - DNA, 20 bp, Artificial Sequence
  Description of Artificial Sequence: Synthetic oligonucleotide
  Target: FXN; (+) strand; PAM type: YTN; PAM sequence: CTA
caggatatgaagaaagtagc

SEQ ID NO: 29955 - DNA, 20 bp, Artificial Sequence
  Description of Artificial Sequence: Synthetic oligonucleotide
  Target: FXN; (+) strand; PAM type: YTN; PAM sequence: TTC
cggttactatggctgtgtaa

SEQ ID NO: 29956 - DNA, 20 bp, Artificial Sequence
  Description of Artificial Sequence: Synthetic oligonucleotide
  Target: FXN; (+) strand; PAM type: YTN; PAM sequence: TTA
ctatggctgtgtaataaatt

SEQ ID NO: 29957 - DNA, 20 bp, Artificial Sequence
  Description of Artificial Sequence: Synthetic oligonucleotide
  Target: FXN; (+) strand; PAM type: YTN; PAM sequence: CTA
tggctgtgtaataaattacc

SEQ ID NO: 29958 - DNA, 20 bp, Artificial Sequence
  Description of Artificial Sequence: Synthetic oligonucleotide
  Target: FXN; (+) strand; PAM type: YTN; PAM sequence: CTG
tgtaataaattacctaaaac

SEQ ID NO: 29959 - DNA, 20 bp, Artificial Sequence
  Description of Artificial Sequence: Synthetic oligonucleotide
  Target: FXN; (+) strand; PAM type: YTN; PAM sequence: TTA
cctaaaacatactggattaa

SEQ ID NO: 29960 - DNA, 20 bp, Artificial Sequence
  Description of Artificial Sequence: Synthetic oligonucleotide
  Target: FXN; (+) strand; PAM type: YTN; PAM sequence: CTA
aaacatactggattaaagct

SEQ ID NO: 29961 - DNA, 20 bp, Artificial Sequence
  Description of Artificial Sequence: Synthetic oligonucleotide
  Target: FXN; (+) strand; PAM type: YTN; PAM sequence: CTG
gattaaagctatgaaaacat

SEQ ID NO: 29962 - DNA, 20 bp, Artificial Sequence
  Description of Artificial Sequence: Synthetic oligonucleotide
  Target: FXN; (+) strand; PAM type: YTN; PAM sequence: TTA
aagctatgaaaacatctttt

SEQ ID NO: 29963 - DNA, 20 bp, Artificial Sequence
  Description of Artificial Sequence: Synthetic oligonucleotide
  Target: FXN; (+) strand; PAM type: YTN; PAM sequence: CTA
tgaaaacatcttttctgccc

SEQ ID NO: 29964 - DNA, 20 bp, Artificial Sequence
  Description of Artificial Sequence: Synthetic oligonucleotide
  Target: FXN; (+) strand; PAM type: YTN; PAM sequence: CTT
ttctgcccagagattctgtg

SEQ ID NO: 29965 - DNA, 20 bp, Artificial Sequence
  Description of Artificial Sequence: Synthetic oligonucleotide
  Target: FXN; (+) strand; PAM type: YTN; PAM sequence: TTT
tctgcccagagattctgtgg

SEQ ID NO: 29966 - DNA, 20 bp, Artificial Sequence
  Description of Artificial Sequence: Synthetic oligonucleotide
  Target: FXN; (+) strand; PAM type: YTN; PAM sequence: TTT
ctgcccagagattctgtggg

SEQ ID NO: 29967 - DNA, 20 bp, Artificial Sequence
  Description of Artificial Sequence: Synthetic oligonucleotide
  Target: FXN; (+) strand; PAM type: YTN; PAM sequence: TTC
tgcccagagattctgtgggc

SEQ ID NO: 29968 - DNA, 20 bp, Artificial Sequence
  Description of Artificial Sequence: Synthetic oligonucleotide
  Target: FXN; (+) strand; PAM type: YTN; PAM sequence: CTG
cccagagattctgtgggcct

SEQ ID NO: 29969 - DNA, 20 bp, Artificial Sequence
  Description of Artificial Sequence: Synthetic oligonucleotide
  Target: FXN; (+) strand; PAM type: YTN; PAM sequence: TTC
tgtgggcctgaaattcacat

SEQ ID NO: 29970 - DNA, 20 bp, Artificial Sequence
  Description of Artificial Sequence: Synthetic oligonucleotide
  Target: FXN; (+) strand; PAM type: YTN; PAM sequence: CTG
tgggcctgaaattcacatgg

SEQ ID NO: 29971 - DNA, 20 bp, Artificial Sequence
  Description of Artificial Sequence: Synthetic oligonucleotide
  Target: FXN; (+) strand; PAM type: YTN; PAM sequence: CTG
aaattcacatggaacacata

SEQ ID NO: 29972 - DNA, 20 bp, Artificial Sequence
  Description of Artificial Sequence: Synthetic oligonucleotide
  Target: FXN; (+) strand; PAM type: YTN; PAM sequence: TTC
acatggaacacataaggcat

SEQ ID NO: 29973 - DNA, 20 bp, Artificial Sequence
  Description of Artificial Sequence: Synthetic oligonucleotide
  Target: FXN; (+) strand; PAM type: YTN; PAM sequence: CTT
gtttctgctccatgatgtct

SEQ ID NO: 29974 - DNA, 20 bp, Artificial Sequence
  Description of Artificial Sequence: Synthetic oligonucleotide
  Target: FXN; (+) strand; PAM type: YTN; PAM sequence: TTG
tttctgctccatgatgtcta

SEQ ID NO: 29975 - DNA, 20 bp, Artificial Sequence
  Description of Artificial Sequence: Synthetic oligonucleotide
  Target: FXN; (+) strand; PAM type: YTN; PAM sequence: TTT
ctgctccatgatgtctaagg

SEQ ID NO: 29976 - DNA, 20 bp, Artificial Sequence
  Description of Artificial Sequence: Synthetic oligonucleotide
  Target: FXN; (+) strand; PAM type: YTN; PAM sequence: TTC
tgctccatgatgtctaagga

SEQ ID NO: 29977 - DNA, 20 bp, Artificial Sequence
  Description of Artificial Sequence: Synthetic oligonucleotide
  Target: FXN; (+) strand; PAM type: YTN; PAM sequence: CTG
ctccatgatgtctaaggatt

SEQ ID NO: 29978 - DNA, 20 bp, Artificial Sequence
  Description of Artificial Sequence: Synthetic oligonucleotide
  Target: FXN; (+) strand; PAM type: YTN; PAM sequence: CTC
catgatgtctaaggattcag

SEQ ID NO: 29979 - DNA, 20 bp, Artificial Sequence
  Description of Artificial Sequence: Synthetic oligonucleotide
  Target: FXN; (+) strand; PAM type: YTN; PAM sequence: CTA
aggattcagctggaagactg

SEQ ID NO: 29980 - DNA, 20 bp, Artificial Sequence
  Description of Artificial Sequence: Synthetic oligonucleotide
  Target: FXN; (+) strand; PAM type: YTN; PAM sequence: TTC
agctggaagactgggaggct

SEQ ID NO: 29981 - DNA, 20 bp, Artificial Sequence
  Description of Artificial Sequence: Synthetic oligonucleotide
  Target: FXN; (+) strand; PAM type: YTN; PAM sequence: CTG
gaagactgggaggctggggg

SEQ ID NO: 29982 - DNA, 20 bp, Artificial Sequence
  Description of Artificial Sequence: Synthetic oligonucleotide
  Target: FXN; (+) strand; PAM type: YTN; PAM sequence: CTG
ggaggctgggggctggaatt

SEQ ID NO: 29983 - DNA, 20 bp, Artificial Sequence
  Description of Artificial Sequence: Synthetic oligonucleotide
  Target: FXN; (+) strand; PAM type: YTN; PAM sequence: CTG
ggggctggaatttatctgaa

SEQ ID NO: 29984 - DNA, 20 bp, Artificial Sequence
  Description of Artificial Sequence: Synthetic oligonucleotide
  Target: FXN; (+) strand; PAM type: YTN; PAM sequence: CTG
gaatttatctgaagaatgac

SEQ ID NO: 29985 - DNA, 20 bp, Artificial Sequence
  Description of Artificial Sequence: Synthetic oligonucleotide
  Target: FXN; (+) strand; PAM type: YTN; PAM sequence: TTT
atctgaagaatgactcattt

SEQ ID NO: 29986 - DNA, 20 bp, Artificial Sequence
  Description of Artificial Sequence: Synthetic oligonucleotide
  Target: FXN; (+) strand; PAM type: YTN; PAM sequence: TTA
tctgaagaatgactcattta

SEQ ID NO: 29987 - DNA, 20 bp, Artificial Sequence
  Description of Artificial Sequence: Synthetic oligonucleotide
  Target: FXN; (+) strand; PAM type: YTN; PAM sequence: CTG
aagaatgactcatttacatg

SEQ ID NO: 29988 - DNA, 20 bp, Artificial Sequence
  Description of Artificial Sequence: Synthetic oligonucleotide
  Target: FXN; (+) strand; PAM type: YTN; PAM sequence: CTC
atttacatgtctactggttg

SEQ ID NO: 29989 - DNA, 20 bp, Artificial Sequence
  Description of Artificial Sequence: Synthetic oligonucleotide
  Target: FXN; (+) strand; PAM type: YTN; PAM sequence: TTT
acatgtctactggttgaccc

SEQ ID NO: 29990 - DNA, 20 bp, Artificial Sequence
  Description of Artificial Sequence: Synthetic oligonucleotide
  Target: FXN; (+) strand; PAM type: YTN; PAM sequence: TTA
catgtctactggttgaccct

SEQ ID NO: 29991 - DNA, 20 bp, Artificial Sequence
  Description of Artificial Sequence: Synthetic oligonucleotide
  Target: FXN; (+) strand; PAM type: YTN; PAM sequence: CTA
ctggttgaccctggctgttg

SEQ ID NO: 29992 - DNA, 20 bp, Artificial Sequence
  Description of Artificial Sequence: Synthetic oligonucleotide
  Target: FXN; (+) strand; PAM type: YTN; PAM sequence: CTG
gttgaccctggctgttggct

SEQ ID NO: 29993 - DNA, 20 bp, Artificial Sequence
  Description of Artificial Sequence: Synthetic oligonucleotide
  Target: FXN; (+) strand; PAM type: YTN; PAM sequence: TTG
accctggctgttggctgagg

SEQ ID NO: 29994 - DNA, 20 bp, Artificial Sequence
  Description of Artificial Sequence: Synthetic oligonucleotide
  Target: FXN; (+) strand; PAM type: YTN; PAM sequence: CTG
gctgttggctgagggggcct

SEQ ID NO: 29995 - DNA, 20 bp, Artificial Sequence
  Description of Artificial Sequence: Synthetic oligonucleotide
  Target: FXN; (+) strand; PAM type: YTN; PAM sequence: CTG
ttggctgagggggcctcagc

SEQ ID NO: 29996 - DNA, 20 bp, Artificial Sequence
  Description of Artificial Sequence: Synthetic oligonucleotide
  Target: FXN; (+) strand; PAM type: YTN; PAM sequence: TTG
gctgagggggcctcagctct

SEQ ID NO: 29997 - DNA, 20 bp, Artificial Sequence
  Description of Artificial Sequence: Synthetic oligonucleotide
  Target: FXN; (+) strand; PAM type: YTN; PAM sequence: CTG
agggggcctcagctctctct

SEQ ID NO: 29998 - DNA, 20 bp, Artificial Sequence
  Description of Artificial Sequence: Synthetic oligonucleotide
  Target: FXN; (+) strand; PAM type: YTN; PAM sequence: CTC
agctctctctacattgtttc

SEQ ID NO: 29999 - DNA, 20 bp, Artificial Sequence
  Description of Artificial Sequence: Synthetic oligonucleotide
  Target: FXN; (+) strand; PAM type: YTN; PAM sequence: CTC
tctctacattgtttctctac

SEQ ID NO: 30000 - DNA, 20 bp, Artificial Sequence
  Description of Artificial Sequence: Synthetic oligonucleotide
  Target: FXN; (+) strand; PAM type: YTN; PAM sequence: CTC
tctacattgtttctctactt

SEQ ID NO: 30001 - DNA, 20 bp, Artificial Sequence
  Description of Artificial Sequence: Synthetic oligonucleotide
  Target: FXN; (+) strand; PAM type: YTN; PAM sequence: CTC
tacattgtttctctactttg

SEQ ID NO: 30002 - DNA, 20 bp, Artificial Sequence
  Description of Artificial Sequence: Synthetic oligonucleotide
  Target: FXN; (+) strand; PAM type: YTN; PAM sequence: CTA
cattgtttctctactttggc

SEQ ID NO: 30003 - DNA, 20 bp, Artificial Sequence
  Description of Artificial Sequence: Synthetic oligonucleotide
  Target: FXN; (+) strand; PAM type: YTN; PAM sequence: TTG
tttctctactttggctagtt

SEQ ID NO: 30004 - DNA, 20 bp, Artificial Sequence
  Description of Artificial Sequence: Synthetic oligonucleotide
  Target: FXN; (+) strand; PAM type: YTN; PAM sequence: TTT
ctctactttggctagtttgg

SEQ ID NO: 30005 - DNA, 20 bp, Artificial Sequence
  Description of Artificial Sequence: Synthetic oligonucleotide
  Target: FXN; (+) strand; PAM type: YTN; PAM sequence: TTC
tctactttggctagtttgga

SEQ ID NO: 30006 - DNA, 20 bp, Artificial Sequence
  Description of Artificial Sequence: Synthetic oligonucleotide
  Target: FXN; (+) strand; PAM type: YTN; PAM sequence: CTC
tactttggctagtttggatt

SEQ ID NO: 30007 - DNA, 20 bp, Artificial Sequence
  Description of Artificial Sequence: Synthetic oligonucleotide
  Target: FXN; (+) strand; PAM type: YTN; PAM sequence: CTA
ctttggctagtttggatttc

SEQ ID NO: 30008 - DNA, 20 bp, Artificial Sequence
  Description of Artificial Sequence: Synthetic oligonucleotide
  Target: FXN; (+) strand; PAM type: YTN; PAM sequence: CTT
tggctagtttggatttcctc

SEQ ID NO: 30009 - DNA, 20 bp, Artificial Sequence
  Description of Artificial Sequence: Synthetic oligonucleotide
  Target: FXN; (+) strand; PAM type: YTN; PAM sequence: TTT
ggctagtttggatttcctca

SEQ ID NO: 30010 - DNA, 20 bp, Artificial Sequence
  Description of Artificial Sequence: Synthetic oligonucleotide
  Target: FXN; (+) strand; PAM type: YTN; PAM sequence: TTG
gctagtttggatttcctcaa

SEQ ID NO: 30011 - DNA, 20 bp, Artificial Sequence
  Description of Artificial Sequence: Synthetic oligonucleotide
  Target: FXN; (+) strand; PAM type: YTN; PAM sequence: CTA
gtttggatttcctcaaaaca

SEQ ID NO: 30012 - DNA, 20 bp, Artificial Sequence
  Description of Artificial Sequence: Synthetic oligonucleotide
  Target: FXN; (+) strand; PAM type: YTN; PAM sequence: TTT
ggatttcctcaaaacatgat

SEQ ID NO: 30013 - DNA, 20 bp, Artificial Sequence
  Description of Artificial Sequence: Synthetic oligonucleotide
  Target: FXN; (+) strand; PAM type: YTN; PAM sequence: TTG
gatttcctcaaaacatgatg

SEQ ID NO: 30014 - DNA, 20 bp, Artificial Sequence
  Description of Artificial Sequence: Synthetic oligonucleotide
  Target: FXN; (+) strand; PAM type: YTN; PAM sequence: TTT
cctcaaaacatgatggctgg

SEQ ID NO: 30015 - DNA, 20 bp, Artificial Sequence
  Description of Artificial Sequence: Synthetic oligonucleotide
  Target: FXN; (+) strand; PAM type: YTN; PAM sequence: TTC
ctcaaaacatgatggctggt

SEQ ID NO: 30016 - DNA, 20 bp, Artificial Sequence
  Description of Artificial Sequence: Synthetic oligonucleotide
  Target: FXN; (+) strand; PAM type: YTN; PAM sequence: CTC
aaaacatgatggctggtcct

SEQ ID NO: 30017 - DNA, 20 bp, Artificial Sequence
  Description of Artificial Sequence: Synthetic oligonucleotide
  Target: FXN; (+) strand; PAM type: YTN; PAM sequence: CTG
gtcctcagtgtcagcatccc

SEQ ID NO: 30018 - DNA, 20 bp, Artificial Sequence
  Description of Artificial Sequence: Synthetic oligonucleotide
  Target: FXN; (+) strand; PAM type: YTN; PAM sequence: CTC
agtgtcagcatcccaaaaag

SEQ ID NO: 30019 - DNA, 20 bp, Artificial Sequence
  Description of Artificial Sequence: Synthetic oligonucleotide
  Target: FXN; (+) strand; PAM type: YTN; PAM sequence: CTC
acacctgtaacctcagcaat

SEQ ID NO: 30020 - DNA, 20 bp, Artificial Sequence
  Description of Artificial Sequence: Synthetic oligonucleotide
  Target: FXN; (+) strand; PAM type: YTN; PAM sequence: CTG
taacctcagcaatttgggag

SEQ ID NO: 30021 - DNA, 20 bp, Artificial Sequence
  Description of Artificial Sequence: Synthetic oligonucleotide
  Target: FXN; (+) strand; PAM type: YTN; PAM sequence: CTC
agcaatttgggaggctgagg

SEQ ID NO: 30022 - DNA, 20 bp, Artificial Sequence
  Description of Artificial Sequence: Synthetic oligonucleotide
  Target: FXN; (+) strand; PAM type: YTN; PAM sequence: TTT
gggaggctgaggtgggaggt

SEQ ID NO: 30023 - DNA, 20 bp, Artificial Sequence
  Description of Artificial Sequence: Synthetic oligonucleotide
  Target: FXN; (+) strand; PAM type: YTN; PAM sequence: TTG
ggaggctgaggtgggaggtt

SEQ ID NO: 30024 - DNA, 20 bp, Artificial Sequence
  Description of Artificial Sequence: Synthetic oligonucleotide
  Target: FXN; (+) strand; PAM type: YTN; PAM sequence: CTG
aggtgggaggttgcttgagt

SEQ ID NO: 30025 - DNA, 20 bp, Artificial Sequence
  Description of Artificial Sequence: Synthetic oligonucleotide
  Target: FXN; (+) strand; PAM type: YTN; PAM sequence: TTG
cttgagttcaggagttcaag

SEQ ID NO: 30026 - DNA, 20 bp, Artificial Sequence
  Description of Artificial Sequence: Synthetic oligonucleotide
  Target: FXN; (+) strand; PAM type: YTN; PAM sequence: CTT
gagttcaggagttcaagacc

SEQ ID NO: 30027 - DNA, 20 bp, Artificial Sequence
  Description of Artificial Sequence: Synthetic oligonucleotide
  Target: FXN; (+) strand; PAM type: YTN; PAM sequence: TTG
agttcaggagttcaagacca

SEQ ID NO: 30028 - DNA, 20 bp, Artificial Sequence
  Description of Artificial Sequence: Synthetic oligonucleotide
  Target: FXN; (+) strand; PAM type: YTN; PAM sequence: TTC
aggagttcaagaccagcctg

SEQ ID NO: 30029 - DNA, 20 bp, Artificial Sequence
  Description of Artificial Sequence: Synthetic oligonucleotide
  Target: FXN; (+) strand; PAM type: YTN; PAM sequence: TTC
aagaccagcctgggcaacat

SEQ ID NO: 30030 - DNA, 20 bp, Artificial Sequence
  Description of Artificial Sequence: Synthetic oligonucleotide
  Target: FXN; (+) strand; PAM type: YTN; PAM sequence: CTG
ggcaacatagtgagactctg

SEQ ID NO: 30031 - DNA, 20 bp, Artificial Sequence
  Description of Artificial Sequence: Synthetic oligonucleotide
  Target: FXN; (+) strand; PAM type: YTN; PAM sequence: CTC
tgtctctaccaaaaattttt

SEQ ID NO: 30032 - DNA, 20 bp, Artificial Sequence
  Description of Artificial Sequence: Synthetic oligonucleotide
  Target: FXN; (+) strand; PAM type: YTN; PAM sequence: CTG
tctctaccaaaaatttttaa

SEQ ID NO: 30033 - DNA, 20 bp, Artificial Sequence
  Description of Artificial Sequence: Synthetic oligonucleotide
  Target: FXN; (+) strand; PAM type: YTN; PAM sequence: CTC
taccaaaaatttttaaaatt

SEQ ID NO: 30034 - DNA, 20 bp, Artificial Sequence
  Description of Artificial Sequence: Synthetic oligonucleotide
  Target: FXN; (+) strand; PAM type: YTN; PAM sequence: CTA
ccaaaaatttttaaaatttt

SEQ ID NO: 30035 - DNA, 20 bp, Artificial Sequence
  Description of Artificial Sequence: Synthetic oligonucleotide
  Target: FXN; (+) strand; PAM type: YTN; PAM sequence: TTT
ttaaaattttaaaaatcagc

SEQ ID NO: 30036 - DNA, 20 bp, Artificial Sequence
  Description of Artificial Sequence: Synthetic oligonucleotide
  Target: FXN; (+) strand; PAM type: YTN; PAM sequence: TTT
taaaattttaaaaatcagcc

SEQ ID NO: 30037 - DNA, 20 bp, Artificial Sequence
  Description of Artificial Sequence: Synthetic oligonucleotide
  Target: FXN; (+) strand; PAM type: YTN; PAM sequence: TTT
aaaattttaaaaatcagcca

SEQ ID NO: 30038 - DNA, 20 bp, Artificial Sequence
  Description of Artificial Sequence: Synthetic oligonucleotide
  Target: FXN; (+) strand; PAM type: YTN; PAM sequence: TTA
aaattttaaaaatcagccag

SEQ ID NO: 30039 - DNA, 20 bp, Artificial Sequence
  Description of Artificial Sequence: Synthetic oligonucleotide
  Target: FXN; (+) strand; PAM type: YTN; PAM sequence: TTT
taaaaatcagccaggtgtgg

SEQ ID NO: 30040 - DNA, 20 bp, Artificial Sequence
  Description of Artificial Sequence: Synthetic oligonucleotide
  Target: FXN; (+) strand; PAM type: YTN; PAM sequence: TTT
aaaaatcagccaggtgtggt

SEQ ID NO: 30041 - DNA, 20 bp, Artificial Sequence
  Description of Artificial Sequence: Synthetic oligonucleotide
  Target: FXN; (+) strand; PAM type: YTN; PAM sequence: TTA
aaaatcagccaggtgtggtt

SEQ ID NO: 30042 - DNA, 20 bp, Artificial Sequence
  Description of Artificial Sequence: Synthetic oligonucleotide
  Target: FXN; (+) strand; PAM type: YTN; PAM sequence: TTA
tgcacacctatagtcccagt

SEQ ID NO: 30043 - DNA, 20 bp, Artificial Sequence
  Description of Artificial Sequence: Synthetic oligonucleotide
  Target: FXN; (+) strand; PAM type: YTN; PAM sequence: CTA
tagtcccagttacttaggag

SEQ ID NO: 30044 - DNA, 20 bp, Artificial Sequence
  Description of Artificial Sequence: Synthetic oligonucleotide
  Target: FXN; (+) strand; PAM type: YTN; PAM sequence: TTA
cttaggaggctgaggcagga

SEQ ID NO: 30045 - DNA, 20 bp, Artificial Sequence
  Description of Artificial Sequence: Synthetic oligonucleotide
  Target: FXN; (+) strand; PAM type: YTN; PAM sequence: CTT
aggaggctgaggcaggagga

SEQ ID NO: 30046 - DNA, 20 bp, Artificial Sequence
  Description of Artificial Sequence: Synthetic oligonucleotide
  Target: FXN; (+) strand; PAM type: YTN; PAM sequence: TTA
ggaggctgaggcaggaggat

SEQ ID NO: 30047 - DNA, 20 bp, Artificial Sequence
  Description of Artificial Sequence: Synthetic oligonucleotide
  Target: FXN; (+) strand; PAM type: YTN; PAM sequence: CTG
aggcaggaggatcacttgat

SEQ ID NO: 30048 - DNA, 20 bp, Artificial Sequence
  Description of Artificial Sequence: Synthetic oligonucleotide
  Target: FXN; (+) strand; PAM type: YTN; PAM sequence: CTT
gattccaggaggtcaaggct

SEQ ID NO: 30049 - DNA, 20 bp, Artificial Sequence
  Description of Artificial Sequence: Synthetic oligonucleotide
  Target: FXN; (+) strand; PAM type: YTN; PAM sequence: TTG
attccaggaggtcaaggctg

SEQ ID NO: 30050 - DNA, 20 bp, Artificial Sequence
  Description of Artificial Sequence: Synthetic oligonucleotide
  Target: FXN; (+) strand; PAM type: YTN; PAM sequence: TTC
caggaggtcaaggctgctgt

SEQ ID NO: 30051 - DNA, 20 bp, Artificial Sequence
  Description of Artificial Sequence: Synthetic oligonucleotide
  Target: FXN; (+) strand; PAM type: YTN; PAM sequence: CTG
ctgtgagctatgaccacacc

SEQ ID NO: 30052 - DNA, 20 bp, Artificial Sequence
  Description of Artificial Sequence: Synthetic oligonucleotide
  Target: FXN; (+) strand; PAM type: YTN; PAM sequence: CTG
tgagctatgaccacaccact

SEQ ID NO: 30053 - DNA, 20 bp, Artificial Sequence
  Description of Artificial Sequence: Synthetic oligonucleotide
  Target: FXN; (+) strand; PAM type: YTN; PAM sequence: CTA
tgaccacaccactgcatttc

SEQ ID NO: 30054 - DNA, 20 bp, Artificial Sequence
  Description of Artificial Sequence: Synthetic oligonucleotide
  Target: FXN; (+) strand; PAM type: YTN; PAM sequence: CTG
catttcagcctgggtaacag

SEQ ID NO: 30055 - DNA, 20 bp, Artificial Sequence
  Description of Artificial Sequence: Synthetic oligonucleotide
  Target: FXN; (+) strand; PAM type: YTN; PAM sequence: TTT
cagcctgggtaacagaatga

SEQ ID NO: 30056 - DNA, 20 bp, Artificial Sequence
  Description of Artificial Sequence: Synthetic oligonucleotide
  Target: FXN; (+) strand; PAM type: YTN; PAM sequence: TTC
agcctgggtaacagaatgag

SEQ ID NO: 30057 - DNA, 20 bp, Artificial Sequence
  Description of Artificial Sequence: Synthetic oligonucleotide
  Target: FXN; (+) strand; PAM type: YTN; PAM sequence: CTG
ggtaacagaatgagactctg

SEQ ID NO: 30058 - DNA, 20 bp, Artificial Sequence
  Description of Artificial Sequence: Synthetic oligonucleotide
  Target: FXN; (+) strand; PAM type: YTN; PAM sequence: CTC
tgtttcaaacaaacaaaaac

SEQ ID NO: 30059 - DNA, 20 bp, Artificial Sequence
  Description of Artificial Sequence: Synthetic oligonucleotide
  Target: FXN; (+) strand; PAM type: YTN; PAM sequence: CTG
tttcaaacaaacaaaaaccc

SEQ ID NO: 30060 - DNA, 20 bp, Artificial Sequence
  Description of Artificial Sequence: Synthetic oligonucleotide
  Target: FXN; (+) strand; PAM type: YTN; PAM sequence: TTT
caaacaaacaaaaacccaaa

SEQ ID NO: 30061 - DNA, 20 bp, Artificial Sequence
  Description of Artificial Sequence: Synthetic oligonucleotide
  Target: FXN; (+) strand; PAM type: YTN; PAM sequence: TTC
aaacaaacaaaaacccaaaa

SEQ ID NO: 30062 - DNA, 20 bp, Artificial Sequence
  Description of Artificial Sequence: Synthetic oligonucleotide
  Target: FXN; (+) strand; PAM type: YTN; PAM sequence: TTA
gaaggaagatgcatcatttt

SEQ ID NO: 30063 - DNA, 20 bp, Artificial Sequence
  Description of Artificial Sequence: Synthetic oligonucleotide
  Target: FXN; (+) strand; PAM type: YTN; PAM sequence: TTT
ttatgacctggacttggaag

SEQ ID NO: 30064 - DNA, 20 bp, Artificial Sequence
  Description of Artificial Sequence: Synthetic oligonucleotide
  Target: FXN; (+) strand; PAM type: YTN; PAM sequence: TTT
tatgacctggacttggaagt

SEQ ID NO: 30065 - DNA, 20 bp, Artificial Sequence
  Description of Artificial Sequence: Synthetic oligonucleotide
  Target: FXN; (+) strand; PAM type: YTN; PAM sequence: TTT
atgacctggacttggaagtc

SEQ ID NO: 30066 - DNA, 20 bp, Artificial Sequence
  Description of Artificial Sequence: Synthetic oligonucleotide
  Target: FXN; (+) strand; PAM type: YTN; PAM sequence: TTA
tgacctggacttggaagtca

SEQ ID NO: 30067 - DNA, 20 bp, Artificial Sequence
  Description of Artificial Sequence: Synthetic oligonucleotide
  Target: FXN; (+) strand; PAM type: YTN; PAM sequence: CTG
gacttggaagtcaccaagca

SEQ ID NO: 30068 - DNA, 20 bp, Artificial Sequence
  Description of Artificial Sequence: Synthetic oligonucleotide
  Target: FXN; (+) strand; PAM type: YTN; PAM sequence: CTT
ggaagtcaccaagcagcact

SEQ ID NO: 30069 - DNA, 20 bp, Artificial Sequence
  Description of Artificial Sequence: Synthetic oligonucleotide
  Target: FXN; (+) strand; PAM type: YTN; PAM sequence: TTG
gaagtcaccaagcagcactt

SEQ ID NO: 30070 - DNA, 20 bp, Artificial Sequence
  Description of Artificial Sequence: Synthetic oligonucleotide
  Target: FXN; (+) strand; PAM type: YTN; PAM sequence: CTT
ctgcagtaccctgttggttg

SEQ ID NO: 30071 - DNA, 20 bp, Artificial Sequence
  Description of Artificial Sequence: Synthetic oligonucleotide
  Target: FXN; (+) strand; PAM type: YTN; PAM sequence: TTC
tgcagtaccctgttggttgg

SEQ ID NO: 30072 - DNA, 20 bp, Artificial Sequence
  Description of Artificial Sequence: Synthetic oligonucleotide
  Target: FXN; (+) strand; PAM type: YTN; PAM sequence: CTG
cagtaccctgttggttggaa

SEQ ID NO: 30073 - DNA, 20 bp, Artificial Sequence
  Description of Artificial Sequence: Synthetic oligonucleotide
  Target: FXN; (+) strand; PAM type: YTN; PAM sequence: CTG
ttggttggaatagttgtagc

SEQ ID NO: 30074 - DNA, 20 bp, Artificial Sequence
  Description of Artificial Sequence: Synthetic oligonucleotide
  Target: FXN; (+) strand; PAM type: YTN; PAM sequence: TTG
gttggaatagttgtagccca

SEQ ID NO: 30075 - DNA, 20 bp, Artificial Sequence
  Description of Artificial Sequence: Synthetic oligonucleotide
  Target: FXN; (+) strand; PAM type: YTN; PAM sequence: TTG
gaatagttgtagcccaaacc

SEQ ID NO: 30076 - DNA, 20 bp, Artificial Sequence
  Description of Artificial Sequence: Synthetic oligonucleotide
  Target: FXN; (+) strand; PAM type: YTN; PAM sequence: TTG
tagcccaaacccgaattcga

SEQ ID NO: 30077 - DNA, 20 bp, Artificial Sequence
  Description of Artificial Sequence: Synthetic oligonucleotide
  Target: FXN; (+) strand; PAM type: YTN; PAM sequence: TTC
gaagggaggagaatagataa

SEQ ID NO: 30078 - DNA, 20 bp, Artificial Sequence
  Description of Artificial Sequence: Synthetic oligonucleotide
  Target: FXN; (+) strand; PAM type: YTN; PAM sequence: CTG
ggtgacaggaatgtcaaagt

SEQ ID NO: 30079 - DNA, 20 bp, Artificial Sequence
  Description of Artificial Sequence: Synthetic oligonucleotide
  Target: FXN; (+) strand; PAM type: YTN; PAM sequence: TTG
gtgtggccttctttggaaga

SEQ ID NO: 30080 - DNA, 20 bp, Artificial Sequence
  Description of Artificial Sequence: Synthetic oligonucleotide
  Target: FXN; (+) strand; PAM type: YTN; PAM sequence: CTT
ctttggaagatccaatcttc

SEQ ID NO: 30081 - DNA, 20 bp, Artificial Sequence
  Description of Artificial Sequence: Synthetic oligonucleotide
  Target: FXN; (+) strand; PAM type: YTN; PAM sequence: TTC
tttggaagatccaatcttcc

SEQ ID NO: 30082 - DNA, 20 bp, Artificial Sequence
  Description of Artificial Sequence: Synthetic oligonucleotide
  Target: FXN; (+) strand; PAM type: YTN; PAM sequence: CTT
tggaagatccaatcttccat

SEQ ID NO: 30083 - DNA, 20 bp, Artificial Sequence
  Description of Artificial Sequence: Synthetic oligonucleotide
  Target: FXN; (+) strand; PAM type: YTN; PAM sequence: TTT
ggaagatccaatcttccata

SEQ ID NO: 30084 - DNA, 20 bp, Artificial Sequence
  Description of Artificial Sequence: Synthetic oligonucleotide
  Target: FXN; (+) strand; PAM type: YTN; PAM sequence: TTG
gaagatccaatcttccatac

SEQ ID NO: 30085 - DNA, 20 bp, Artificial Sequence
  Description of Artificial Sequence: Synthetic oligonucleotide
  Target: FXN; (+) strand; PAM type: YTN; PAM sequence: CTT
ccataccaggcaaagggatg

SEQ ID NO: 30086 - DNA, 20 bp, Artificial Sequence
  Description of Artificial Sequence: Synthetic oligonucleotide
  Target: FXN; (+) strand; PAM type: YTN; PAM sequence: TTC
cataccaggcaaagggatgg

SEQ ID NO: 30087 - DNA, 20 bp, Artificial Sequence
  Description of Artificial Sequence: Synthetic oligonucleotide
  Target: FXN; (+) strand; PAM type: YTN; PAM sequence: CTA
aggaacaacatgagggatag

SEQ ID NO: 30088 - DNA, 20 bp, Artificial Sequence
  Description of Artificial Sequence: Synthetic oligonucleotide
  Target: FXN; (+) strand; PAM type: YTN; PAM sequence: CTT
gttctaggaactacaaatag

SEQ ID NO: 30089 - DNA, 20 bp, Artificial Sequence
  Description of Artificial Sequence: Synthetic oligonucleotide
  Target: FXN; (+) strand; PAM type: YTN; PAM sequence: TTG
ttctaggaactacaaatagc

SEQ ID NO: 30090 - DNA, 20 bp, Artificial Sequence
  Description of Artificial Sequence: Synthetic oligonucleotide
  Target: FXN; (+) strand; PAM type: YTN; PAM sequence: TTC
taggaactacaaatagcttg

SEQ ID NO: 30091 - DNA, 20 bp, Artificial Sequence
  Description of Artificial Sequence: Synthetic oligonucleotide
  Target: FXN; (+) strand; PAM type: YTN; PAM sequence: CTA
ggaactacaaatagcttgaa

SEQ ID NO: 30092 - DNA, 20 bp, Artificial Sequence
  Description of Artificial Sequence: Synthetic oligonucleotide
  Target: FXN; (+) strand; PAM type: YTN; PAM sequence: CTA
caaatagcttgaagaagcaa

SEQ ID NO: 30093 - DNA, 20 bp, Artificial Sequence
  Description of Artificial Sequence: Synthetic oligonucleotide
  Target: FXN; (+) strand; PAM type: YTN; PAM sequence: CTT
gaagaagcaaagatgtctag

SEQ ID NO: 30094 - DNA, 20 bp, Artificial Sequence
  Description of Artificial Sequence: Synthetic oligonucleotide
  Target: FXN; (+) strand; PAM type: YTN; PAM sequence: TTG
aagaagcaaagatgtctaga

SEQ ID NO: 30095 - DNA, 20 bp, Artificial Sequence
  Description of Artificial Sequence: Synthetic oligonucleotide
  Target: FXN; (+) strand; PAM type: YTN; PAM sequence: CTA
gatgcctcccaatatgcaga

SEQ ID NO: 30096 - DNA, 20 bp, Artificial Sequence
  Description of Artificial Sequence: Synthetic oligonucleotide
  Target: FXN; (+) strand; PAM type: YTN; PAM sequence: CTC
ccaatatgcagagtggggtg

SEQ ID NO: 30097 - DNA, 20 bp, Artificial Sequence
  Description of Artificial Sequence: Synthetic oligonucleotide
  Target: FXN; (+) strand; PAM type: YTN; PAM sequence: CTG
ggagagctaaggtgggcaag

SEQ ID NO: 30098 - DNA, 20 bp, Artificial Sequence
  Description of Artificial Sequence: Synthetic oligonucleotide
  Target: FXN; (+) strand; PAM type: YTN; PAM sequence: CTA
aggtgggcaagagagcttcc

SEQ ID NO: 30099 - DNA, 20 bp, Artificial Sequence
  Description of Artificial Sequence: Synthetic oligonucleotide
  Target: FXN; (+) strand; PAM type: YTN; PAM sequence: CTT
cctctgtcatgctaagaaag

SEQ ID NO: 30100 - DNA, 20 bp, Artificial Sequence
  Description of Artificial Sequence: Synthetic oligonucleotide
  Target: FXN; (+) strand; PAM type: YTN; PAM sequence: TTC
ctctgtcatgctaagaaagt

SEQ ID NO: 30101 - DNA, 20 bp, Artificial Sequence
  Description of Artificial Sequence: Synthetic oligonucleotide
  Target: FXN; (+) strand; PAM type: YTN; PAM sequence: CTC
tgtcatgctaagaaagttgg

SEQ ID NO: 30102 - DNA, 20 bp, Artificial Sequence
  Description of Artificial Sequence: Synthetic oligonucleotide
  Target: FXN; (+) strand; PAM type: YTN; PAM sequence: CTG
tcatgctaagaaagttggaa

SEQ ID NO: 30103 - DNA, 20 bp, Artificial Sequence
  Description of Artificial Sequence: Synthetic oligonucleotide
  Target: FXN; (+) strand; PAM type: YTN; PAM sequence: CTA
agaaagttggaatttatctt

SEQ ID NO: 30104 - DNA, 20 bp, Artificial Sequence
  Description of Artificial Sequence: Synthetic oligonucleotide
  Target: FXN; (+) strand; PAM type: YTN; PAM sequence: TTG
gaatttatcttgatggtggt

SEQ ID NO: 30105 - DNA, 20 bp, Artificial Sequence
  Description of Artificial Sequence: Synthetic oligonucleotide
  Target: FXN; (+) strand; PAM type: YTN; PAM sequence: TTT
atcttgatggtggtgaaagc

SEQ ID NO: 30106 - DNA, 20 bp, Artificial Sequence
  Description of Artificial Sequence: Synthetic oligonucleotide
  Target: FXN; (+) strand; PAM type: YTN; PAM sequence: TTA
tcttgatggtggtgaaagca

SEQ ID NO: 30107 - DNA, 20 bp, Artificial Sequence
  Description of Artificial Sequence: Synthetic oligonucleotide
  Target: FXN; (+) strand; PAM type: YTN; PAM sequence: CTT
gatggtggtgaaagcagagg

SEQ ID NO: 30108 - DNA, 20 bp, Artificial Sequence
  Description of Artificial Sequence: Synthetic oligonucleotide
  Target: FXN; (+) strand; PAM type: YTN; PAM sequence: TTG
atggtggtgaaagcagaggg

SEQ ID NO: 30109 - DNA, 20 bp, Artificial Sequence
  Description of Artificial Sequence: Synthetic oligonucleotide
  Target: FXN; (+) strand; PAM type: YTN; PAM sequence: CTA
tggttagattcacatttgag

SEQ ID NO: 30110 - DNA, 20 bp, Artificial Sequence
  Description of Artificial Sequence: Synthetic oligonucleotide
  Target: FXN; (+) strand; PAM type: YTN; PAM sequence: TTA
gattcacatttgagatttag

SEQ ID NO: 30111 - DNA, 20 bp, Artificial Sequence
  Description of Artificial Sequence: Synthetic oligonucleotide
  Target: FXN; (+) strand; PAM type: YTN; PAM sequence: TTC
acatttgagatttagatttt

SEQ ID NO: 30112 - DNA, 20 bp, Artificial Sequence
  Description of Artificial Sequence: Synthetic oligonucleotide
  Target: FXN; (+) strand; PAM type: YTN; PAM sequence: TTT
gagatttagatttttagatt

SEQ ID NO: 30113 - DNA, 20 bp, Artificial Sequence
  Description of Artificial Sequence: Synthetic oligonucleotide
  Target: FXN; (+) strand; PAM type: YTN; PAM sequence: TTG
agatttagatttttagattt

SEQ ID NO: 30114 - DNA, 20 bp, Artificial Sequence
  Description of Artificial Sequence: Synthetic oligonucleotide
  Target: FXN; (+) strand; PAM type: YTN; PAM sequence: TTT
agatttttagatttaaaatg

SEQ ID NO: 30115 - DNA, 20 bp, Artificial Sequence
  Description of Artificial Sequence: Synthetic oligonucleotide
  Target: FXN; (+) strand; PAM type: YTN; PAM sequence: TTA
gatttttagatttaaaatga

SEQ ID NO: 30116 - DNA, 20 bp, Artificial Sequence
  Description of Artificial Sequence: Synthetic oligonucleotide
  Target: FXN; (+) strand; PAM type: YTN; PAM sequence: TTT
ttagatttaaaatgatcacc

SEQ ID NO: 30117 - DNA, 20 bp, Artificial Sequence
  Description of Artificial Sequence: Synthetic oligonucleotide
  Target: FXN; (+) strand; PAM type: YTN; PAM sequence: TTT
tagatttaaaatgatcaccc

SEQ ID NO: 30118 - DNA, 20 bp, Artificial Sequence
  Description of Artificial Sequence: Synthetic oligonucleotide
  Target: FXN; (+) strand; PAM type: YTN; PAM sequence: TTT
agatttaaaatgatcaccct

SEQ ID NO: 30119 - DNA, 20 bp, Artificial Sequence
  Description of Artificial Sequence: Synthetic oligonucleotide
  Target: FXN; (+) strand; PAM type: YTN; PAM sequence: TTA
gatttaaaatgatcaccctg

SEQ ID NO: 30120 - DNA, 20 bp, Artificial Sequence
  Description of Artificial Sequence: Synthetic oligonucleotide
  Target: FXN; (+) strand; PAM type: YTN; PAM sequence: TTT
aaaatgatcaccctggtgac

SEQ ID NO: 30121 - DNA, 20 bp, Artificial Sequence
  Description of Artificial Sequence: Synthetic oligonucleotide
  Target: FXN; (+) strand; PAM type: YTN; PAM sequence: TTA
aaatgatcaccctggtgaca

SEQ ID NO: 30122 - DNA, 20 bp, Artificial Sequence
  Description of Artificial Sequence: Synthetic oligonucleotide
  Target: FXN; (+) strand; PAM type: YTN; PAM sequence: CTG
gtgacactggcttaactcac

SEQ ID NO: 30123 - DNA, 20 bp, Artificial Sequence
  Description of Artificial Sequence: Synthetic oligonucleotide
  Target: FXN; (+) strand; PAM type: YTN; PAM sequence: CTG
gcttaactcacaattttgcc

SEQ ID NO: 30124 - DNA, 20 bp, Artificial Sequence
  Description of Artificial Sequence: Synthetic oligonucleotide
  Target: FXN; (+) strand; PAM type: YTN; PAM sequence: CTT
aactcacaattttgcccaag

SEQ ID NO: 30125 - DNA, 20 bp, Artificial Sequence
  Description of Artificial Sequence: Synthetic oligonucleotide
  Target: FXN; (+) strand; PAM type: YTN; PAM sequence: TTA
actcacaattttgcccaagg

SEQ ID NO: 30126 - DNA, 20 bp, Artificial Sequence
  Description of Artificial Sequence: Synthetic oligonucleotide
  Target: FXN; (+) strand; PAM type: YTN; PAM sequence: CTC
acaattttgcccaaggccta

SEQ ID NO: 30127 - DNA, 20 bp, Artificial Sequence
  Description of Artificial Sequence: Synthetic oligonucleotide
  Target: FXN; (+) strand; PAM type: YTN; PAM sequence: TTT
tgcccaaggcctatgctacc

SEQ ID NO: 30128 - DNA, 20 bp, Artificial Sequence
  Description of Artificial Sequence: Synthetic oligonucleotide
  Target: FXN; (+) strand; PAM type: YTN; PAM sequence: TTT
gcccaaggcctatgctacca

SEQ ID NO: 30129 - DNA, 20 bp, Artificial Sequence
  Description of Artificial Sequence: Synthetic oligonucleotide
  Target: FXN; (+) strand; PAM type: YTN; PAM sequence: TTG
cccaaggcctatgctaccac

SEQ ID NO: 30130 - DNA, 20 bp, Artificial Sequence
  Description of Artificial Sequence: Synthetic oligonucleotide
  Target: FXN; (+) strand; PAM type: YTN; PAM sequence: CTA
tgctaccacagtgcttctga

SEQ ID NO: 30131 - DNA, 20 bp, Artificial Sequence
  Description of Artificial Sequence: Synthetic oligonucleotide
  Target: FXN; (+) strand; PAM type: YTN; PAM sequence: CTA
ccacagtgcttctgaaactt

SEQ ID NO: 30132 - DNA, 20 bp, Artificial Sequence
  Description of Artificial Sequence: Synthetic oligonucleotide
  Target: FXN; (+) strand; PAM type: YTN; PAM sequence: CTT
ctgaaactttaaagcacatt

SEQ ID NO: 30133 - DNA, 20 bp, Artificial Sequence
  Description of Artificial Sequence: Synthetic oligonucleotide
  Target: FXN; (+) strand; PAM type: YTN; PAM sequence: TTC
tgaaactttaaagcacatta

SEQ ID NO: 30134 - DNA, 20 bp, Artificial Sequence
  Description of Artificial Sequence: Synthetic oligonucleotide
  Target: FXN; (+) strand; PAM type: YTN; PAM sequence: CTG
aaactttaaagcacattaga

SEQ ID NO: 30135 - DNA, 20 bp, Artificial Sequence
  Description of Artificial Sequence: Synthetic oligonucleotide
  Target: FXN; (+) strand; PAM type: YTN; PAM sequence: CTT
taaagcacattagaatcacc

SEQ ID NO: 30136 - DNA, 20 bp, Artificial Sequence
  Description of Artificial Sequence: Synthetic oligonucleotide
  Target: FXN; (+) strand; PAM type: YTN; PAM sequence: TTT
aaagcacattagaatcacct

SEQ ID NO: 30137 - DNA, 20 bp, Artificial Sequence
  Description of Artificial Sequence: Synthetic oligonucleotide
  Target: FXN; (+) strand; PAM type: YTN; PAM sequence: TTA
aagcacattagaatcacctg

SEQ ID NO: 30138 - DNA, 20 bp, Artificial Sequence
  Description of Artificial Sequence: Synthetic oligonucleotide
  Target: FXN; (+) strand; PAM type: YTN; PAM sequence: TTA
gaatcacctggaggtcttgt

SEQ ID NO: 30139 - DNA, 20 bp, Artificial Sequence
  Description of Artificial Sequence: Synthetic oligonucleotide
  Target: FXN; (+) strand; PAM type: YTN; PAM sequence: CTG
gaggtcttgttaaaccatgg

SEQ ID NO: 30140 - DNA, 20 bp, Artificial Sequence
  Description of Artificial Sequence: Synthetic oligonucleotide
  Target: FXN; (+) strand; PAM type: YTN; PAM sequence: CTT
gttaaaccatggattgctgg

SEQ ID NO: 30141 - DNA, 20 bp, Artificial Sequence
  Description of Artificial Sequence: Synthetic oligonucleotide
  Target: FXN; (+) strand; PAM type: YTN; PAM sequence: TTG
ttaaaccatggattgctggg

SEQ ID NO: 30142 - DNA, 20 bp, Artificial Sequence
  Description of Artificial Sequence: Synthetic oligonucleotide
  Target: FXN; (+) strand; PAM type: YTN; PAM sequence: TTA
aaccatggattgctgggcct

SEQ ID NO: 30143 - DNA, 20 bp, Artificial Sequence
  Description of Artificial Sequence: Synthetic oligonucleotide
  Target: FXN; (+) strand; PAM type: YTN; PAM sequence: TTG
ctgggccttgaaaccccaga

SEQ ID NO: 30144 - DNA, 20 bp, Artificial Sequence
  Description of Artificial Sequence: Synthetic oligonucleotide
  Target: FXN; (+) strand; PAM type: YTN; PAM sequence: CTG
ggccttgaaaccccagagat

SEQ ID NO: 30145 - DNA, 20 bp, Artificial Sequence
  Description of Artificial Sequence: Synthetic oligonucleotide
  Target: FXN; (+) strand; PAM type: YTN; PAM sequence: CTT
gaaaccccagagattctgat

SEQ ID NO: 30146 - DNA, 20 bp, Artificial Sequence
  Description of Artificial Sequence: Synthetic oligonucleotide
  Target: FXN; (+) strand; PAM type: YTN; PAM sequence: TTG
aaaccccagagattctgatt

SEQ ID NO: 30147 - DNA, 20 bp, Artificial Sequence
  Description of Artificial Sequence: Synthetic oligonucleotide
  Target: FXN; (+) strand; PAM type: YTN; PAM sequence: TTC
tgattcagtagatcgagaat

SEQ ID NO: 30148 - DNA, 20 bp, Artificial Sequence
  Description of Artificial Sequence: Synthetic oligonucleotide
  Target: FXN; (+) strand; PAM type: YTN; PAM sequence: CTG
attcagtagatcgagaatag

SEQ ID NO: 30149 - DNA, 20 bp, Artificial Sequence
  Description of Artificial Sequence: Synthetic oligonucleotide
  Target: FXN; (+) strand; PAM type: YTN; PAM sequence: TTC
agtagatcgagaatagggcc

SEQ ID NO: 30150 - DNA, 20 bp, Artificial Sequence
  Description of Artificial Sequence: Synthetic oligonucleotide
  Target: FXN; (+) strand; PAM type: YTN; PAM sequence: CTG
agaatttgtatttctaacaa

SEQ ID NO: 30151 - DNA, 20 bp, Artificial Sequence
  Description of Artificial Sequence: Synthetic oligonucleotide
  Target: FXN; (+) strand; PAM type: YTN; PAM sequence: TTT
gtatttctaacaagtttcca

SEQ ID NO: 30152 - DNA, 20 bp, Artificial Sequence
  Description of Artificial Sequence: Synthetic oligonucleotide
  Target: FXN; (+) strand; PAM type: YTN; PAM sequence: TTG
tatttctaacaagtttccag

SEQ ID NO: 30153 - DNA, 20 bp, Artificial Sequence
  Description of Artificial Sequence: Synthetic oligonucleotide
  Target: FXN; (+) strand; PAM type: YTN; PAM sequence: TTT
ctaacaagtttccaggtgat

SEQ ID NO: 30154 - DNA, 20 bp, Artificial Sequence
  Description of Artificial Sequence: Synthetic oligonucleotide
  Target: FXN; (+) strand; PAM type: YTN; PAM sequence: TTC
taacaagtttccaggtgatg

SEQ ID NO: 30155 - DNA, 20 bp, Artificial Sequence
  Description of Artificial Sequence: Synthetic oligonucleotide
  Target: FXN; (+) strand; PAM type: YTN; PAM sequence: CTA
acaagtttccaggtgatgct

SEQ ID NO: 30156 - DNA, 20 bp, Artificial Sequence
  Description of Artificial Sequence: Synthetic oligonucleotide
  Target: FXN; (+) strand; PAM type: YTN; PAM sequence: TTT
ccaggtgatgctgaggctgc

SEQ ID NO: 30157 - DNA, 20 bp, Artificial Sequence
  Description of Artificial Sequence: Synthetic oligonucleotide
  Target: FXN; (+) strand; PAM type: YTN; PAM sequence: TTC
caggtgatgctgaggctgct

SEQ ID NO: 30158 - DNA, 20 bp, Artificial Sequence
  Description of Artificial Sequence: Synthetic oligonucleotide
  Target: FXN; (+) strand; PAM type: YTN; PAM sequence: CTG
aggctgctggcccagcgacc

SEQ ID NO: 30159 - DNA, 20 bp, Artificial Sequence
  Description of Artificial Sequence: Synthetic oligonucleotide
  Target: FXN; (+) strand; PAM type: YTN; PAM sequence: CTG
ctggcccagcgaccacattt

SEQ ID NO: 30160 - DNA, 20 bp, Artificial Sequence
  Description of Artificial Sequence: Synthetic oligonucleotide
  Target: FXN; (+) strand; PAM type: YTN; PAM sequence: CTG
gcccagcgaccacatttgat

SEQ ID NO: 30161 - DNA, 20 bp, Artificial Sequence
  Description of Artificial Sequence: Synthetic oligonucleotide
  Target: FXN; (+) strand; PAM type: YTN; PAM sequence: TTT
gataatcatagccctctgat

SEQ ID NO: 30162 - DNA, 20 bp, Artificial Sequence
  Description of Artificial Sequence: Synthetic oligonucleotide
  Target: FXN; (+) strand; PAM type: YTN; PAM sequence: TTG
ataatcatagccctctgata

SEQ ID NO: 30163 - DNA, 20 bp, Artificial Sequence
  Description of Artificial Sequence: Synthetic oligonucleotide
  Target: FXN; (+) strand; PAM type: YTN; PAM sequence: CTC
tgataaatcctatcaaaata

SEQ ID NO: 30164 - DNA, 20 bp, Artificial Sequence
  Description of Artificial Sequence: Synthetic oligonucleotide
  Target: FXN; (+) strand; PAM type: YTN; PAM sequence: CTG
ataaatcctatcaaaatatc

SEQ ID NO: 30165 - DNA, 20 bp, Artificial Sequence
  Description of Artificial Sequence: Synthetic oligonucleotide
  Target: FXN; (+) strand; PAM type: YTN; PAM sequence: CTA
tcaaaatatcctaatggcag

SEQ ID NO: 30166 - DNA, 20 bp, Artificial Sequence
  Description of Artificial Sequence: Synthetic oligonucleotide
  Target: FXN; (+) strand; PAM type: YTN; PAM sequence: CTA
atggcagagcaagggaattc

SEQ ID NO: 30167 - DNA, 20 bp, Artificial Sequence
  Description of Artificial Sequence: Synthetic oligonucleotide
  Target: FXN; (+) strand; PAM type: YTN; PAM sequence: TTC
tggtgatatcctcccctacc

SEQ ID NO: 30168 - DNA, 20 bp, Artificial Sequence
  Description of Artificial Sequence: Synthetic oligonucleotide
  Target: FXN; (+) strand; PAM type: YTN; PAM sequence: CTG
gtgatatcctcccctaccca

SEQ ID NO: 30169 - DNA, 20 bp, Artificial Sequence
  Description of Artificial Sequence: Synthetic oligonucleotide
  Target: FXN; (+) strand; PAM type: YTN; PAM sequence: CTC
ccctacccataacctgacag

SEQ ID NO: 30170 - DNA, 20 bp, Artificial Sequence
  Description of Artificial Sequence: Synthetic oligonucleotide
  Target: FXN; (+) strand; PAM type: YTN; PAM sequence: CTA
cccataacctgacagctatt

SEQ ID NO: 30171 - DNA, 20 bp, Artificial Sequence
  Description of Artificial Sequence: Synthetic oligonucleotide
  Target: FXN; (+) strand; PAM type: YTN; PAM sequence: CTG
acagctattaggatctgcct

SEQ ID NO: 30172 - DNA, 20 bp, Artificial Sequence
  Description of Artificial Sequence: Synthetic oligonucleotide
  Target: FXN; (+) strand; PAM type: YTN; PAM sequence: CTA
ttaggatctgcctacttgag

SEQ ID NO: 30173 - DNA, 20 bp, Artificial Sequence
  Description of Artificial Sequence: Synthetic oligonucleotide
  Target: FXN; (+) strand; PAM type: YTN; PAM sequence: TTA
ggatctgcctacttgaggct

SEQ ID NO: 30174 - DNA, 20 bp, Artificial Sequence
  Description of Artificial Sequence: Synthetic oligonucleotide
  Target: FXN; (+) strand; PAM type: YTN; PAM sequence: CTG
cctacttgaggctaaaagca

SEQ ID NO: 30175 - DNA, 20 bp, Artificial Sequence
  Description of Artificial Sequence: Synthetic oligonucleotide
  Target: FXN; (+) strand; PAM type: YTN; PAM sequence: CTA
cttgaggctaaaagcaacca

SEQ ID NO: 30176 - DNA, 20 bp, Artificial Sequence
  Description of Artificial Sequence: Synthetic oligonucleotide
  Target: FXN; (+) strand; PAM type: YTN; PAM sequence: CTT
gaggctaaaagcaaccaaga

SEQ ID NO: 30177 - DNA, 20 bp, Artificial Sequence
  Description of Artificial Sequence: Synthetic oligonucleotide
  Target: FXN; (+) strand; PAM type: YTN; PAM sequence: TTG
aggctaaaagcaaccaagag

SEQ ID NO: 30178 - DNA, 20 bp, Artificial Sequence
  Description of Artificial Sequence: Synthetic oligonucleotide
  Target: FXN; (+) strand; PAM type: YTN; PAM sequence: CTA
aaagcaaccaagagaggaac

SEQ ID NO: 30179 - DNA, 20 bp, Artificial Sequence
  Description of Artificial Sequence: Synthetic oligonucleotide
  Target: FXN; (+) strand; PAM type: YTN; PAM sequence: CTA
cagtgtaccacagagtccct

SEQ ID NO: 30180 - DNA, 20 bp, Artificial Sequence
  Description of Artificial Sequence: Synthetic oligonucleotide
  Target: FXN; (+) strand; PAM type: YTN; PAM sequence: CTC
aacatctttgcccacgccac

SEQ ID NO: 30181 - DNA, 20 bp, Artificial Sequence
  Description of Artificial Sequence: Synthetic oligonucleotide
  Target: FXN; (+) strand; PAM type: YTN; PAM sequence: CTT
tgcccacgccacggtgcccc

SEQ ID NO: 30182 - DNA, 20 bp, Artificial Sequence
  Description of Artificial Sequence: Synthetic oligonucleotide
  Target: FXN; (+) strand; PAM type: YTN; PAM sequence: TTT
gcccacgccacggtgcccca

SEQ ID NO: 30183 - DNA, 20 bp, Artificial Sequence
  Description of Artificial Sequence: Synthetic oligonucleotide
  Target: FXN; (+) strand; PAM type: YTN; PAM sequence: TTG
cccacgccacggtgccccag

SEQ ID NO: 30184 - DNA, 20 bp, Artificial Sequence
  Description of Artificial Sequence: Synthetic oligonucleotide
  Target: FXN; (+) strand; PAM type: YTN; PAM sequence: CTT
cttaccaagtgtgcctgatt

SEQ ID NO: 30185 - DNA, 20 bp, Artificial Sequence
  Description of Artificial Sequence: Synthetic oligonucleotide
  Target: FXN; (+) strand; PAM type: YTN; PAM sequence: TTC
ttaccaagtgtgcctgattc

SEQ ID NO: 30186 - DNA, 20 bp, Artificial Sequence
  Description of Artificial Sequence: Synthetic oligonucleotide
  Target: FXN; (+) strand; PAM type: YTN; PAM sequence: CTT
accaagtgtgcctgattcct

SEQ ID NO: 30187 - DNA, 20 bp, Artificial Sequence
  Description of Artificial Sequence: Synthetic oligonucleotide
  Target: FXN; (+) strand; PAM type: YTN; PAM sequence: TTA
ccaagtgtgcctgattcctc

SEQ ID NO: 30188 - DNA, 20 bp, Artificial Sequence
  Description of Artificial Sequence: Synthetic oligonucleotide
  Target: FXN; (+) strand; PAM type: YTN; PAM sequence: CTG
attcctcttgactacctcca

SEQ ID NO: 30189 - DNA, 20 bp, Artificial Sequence
  Description of Artificial Sequence: Synthetic oligonucleotide
  Target: FXN; (+) strand; PAM type: YTN; PAM sequence: TTC
ctcttgactacctccaagga

SEQ ID NO: 30190 - DNA, 20 bp, Artificial Sequence
  Description of Artificial Sequence: Synthetic oligonucleotide
  Target: FXN; (+) strand; PAM type: YTN; PAM sequence: CTC
ttgactacctccaaggaagt

SEQ ID NO: 30191 - DNA, 20 bp, Artificial Sequence
  Description of Artificial Sequence: Synthetic oligonucleotide
  Target: FXN; (+) strand; PAM type: YTN; PAM sequence: CTT
gactacctccaaggaagtgg

SEQ ID NO: 30192 - DNA, 20 bp, Artificial Sequence
  Description of Artificial Sequence: Synthetic oligonucleotide
  Target: FXN; (+) strand; PAM type: YTN; PAM sequence: TTG
actacctccaaggaagtgga

SEQ ID NO: 30193 - DNA, 20 bp, Artificial Sequence
  Description of Artificial Sequence: Synthetic oligonucleotide
  Target: FXN; (+) strand; PAM type: YTN; PAM sequence: CTA
cctccaaggaagtggagaaa

SEQ ID NO: 30194 - DNA, 20 bp, Artificial Sequence
  Description of Artificial Sequence: Synthetic oligonucleotide
  Target: FXN; (+) strand; PAM type: YTN; PAM sequence: CTC
caaggaagtggagaaagaca

SEQ ID NO: 30195 - DNA, 20 bp, Artificial Sequence
  Description of Artificial Sequence: Synthetic oligonucleotide
  Target: FXN; (+) strand; PAM type: YTN; PAM sequence: TTC
ttgcgaagccttcgtcttct

SEQ ID NO: 30196 - DNA, 20 bp, Artificial Sequence
  Description of Artificial Sequence: Synthetic oligonucleotide
  Target: FXN; (+) strand; PAM type: YTN; PAM sequence: CTT
gcgaagccttcgtcttctct

SEQ ID NO: 30197 - DNA, 20 bp, Artificial Sequence
  Description of Artificial Sequence: Synthetic oligonucleotide
  Target: FXN; (+) strand; PAM type: YTN; PAM sequence: TTG
cgaagccttcgtcttctctg

SEQ ID NO: 30198 - DNA, 20 bp, Artificial Sequence
  Description of Artificial Sequence: Synthetic oligonucleotide
  Target: FXN; (+) strand; PAM type: YTN; PAM sequence: CTT
cgtcttctctgatatgctat

SEQ ID NO: 30199 - DNA, 20 bp, Artificial Sequence
  Description of Artificial Sequence: Synthetic oligonucleotide
  Target: FXN; (+) strand; PAM type: YTN; PAM sequence: TTC
gtcttctctgatatgctatt

SEQ ID NO: 30200 - DNA, 20 bp, Artificial Sequence
  Description of Artificial Sequence: Synthetic oligonucleotide
  Target: FXN; (+) strand; PAM type: YTN; PAM sequence: CTT
ctctgatatgctattctatg

SEQ ID NO: 30201 - DNA, 20 bp, Artificial Sequence
  Description of Artificial Sequence: Synthetic oligonucleotide
  Target: FXN; (+) strand; PAM type: YTN; PAM sequence: TTC
tctgatatgctattctatgt

SEQ ID NO: 30202 - DNA, 20 bp, Artificial Sequence
  Description of Artificial Sequence: Synthetic oligonucleotide
  Target: FXN; (+) strand; PAM type: YTN; PAM sequence: CTC
tgatatgctattctatgtct

SEQ ID NO: 30203 - DNA, 20 bp, Artificial Sequence
  Description of Artificial Sequence: Synthetic oligonucleotide
  Target: FXN; (+) strand; PAM type: YTN; PAM sequence: CTG
atatgctattctatgtctat

SEQ ID NO: 30204 - DNA, 20 bp, Artificial Sequence
  Description of Artificial Sequence: Synthetic oligonucleotide
  Target: FXN; (+) strand; PAM type: YTN; PAM sequence: CTA
ttctatgtctatttctttgg

SEQ ID NO: 30205 - DNA, 20 bp, Artificial Sequence
  Description of Artificial Sequence: Synthetic oligonucleotide
  Target: FXN; (+) strand; PAM type: YTN; PAM sequence: TTC
tatgtctatttctttggcca

SEQ ID NO: 30206 - DNA, 20 bp, Artificial Sequence
  Description of Artificial Sequence: Synthetic oligonucleotide
  Target: FXN; (+) strand; PAM type: YTN; PAM sequence: CTA
tgtctatttctttggccaaa

SEQ ID NO: 30207 - DNA, 20 bp, Artificial Sequence
  Description of Artificial Sequence: Synthetic oligonucleotide
  Target: FXN; (+) strand; PAM type: YTN; PAM sequence: CTA
tttctttggccaaaaagatg

SEQ ID NO: 30208 - DNA, 20 bp, Artificial Sequence
  Description of Artificial Sequence: Synthetic oligonucleotide
  Target: FXN; (+) strand; PAM type: YTN; PAM sequence: TTT
ctttggccaaaaagatgggg

SEQ ID NO: 30209 - DNA, 20 bp, Artificial Sequence
  Description of Artificial Sequence: Synthetic oligonucleotide
  Target: FXN; (+) strand; PAM type: YTN; PAM sequence: TTC
tttggccaaaaagatggggc

SEQ ID NO: 30210 - DNA, 20 bp, Artificial Sequence
  Description of Artificial Sequence: Synthetic oligonucleotide
  Target: FXN; (+) strand; PAM type: YTN; PAM sequence: CTT
tggccaaaaagatggggcaa

SEQ ID NO: 30211 - DNA, 20 bp, Artificial Sequence
  Description of Artificial Sequence: Synthetic oligonucleotide
  Target: FXN; (+) strand; PAM type: YTN; PAM sequence: TTT
ggccaaaaagatggggcaat

SEQ ID NO: 30212 - DNA, 20 bp, Artificial Sequence
  Description of Artificial Sequence: Synthetic oligonucleotide
  Target: FXN; (+) strand; PAM type: YTN; PAM sequence: TTG
gccaaaaagatggggcaatg

SEQ ID NO: 30213 - DNA, 20 bp, Artificial Sequence
  Description of Artificial Sequence: Synthetic oligonucleotide
  Target: FXN; (+) strand; PAM type: YTN; PAM sequence: CTT
tgcagggagctggagcattt

SEQ ID NO: 30214 - DNA, 20 bp, Artificial Sequence
  Description of Artificial Sequence: Synthetic oligonucleotide
  Target: FXN; (+) strand; PAM type: YTN; PAM sequence: TTT
gcagggagctggagcatttg

SEQ ID NO: 30215 - DNA, 20 bp, Artificial Sequence
  Description of Artificial Sequence: Synthetic oligonucleotide
  Target: FXN; (+) strand; PAM type: YTN; PAM sequence: TTG
cagggagctggagcatttgc

SEQ ID NO: 30216 - DNA, 20 bp, Artificial Sequence
  Description of Artificial Sequence: Synthetic oligonucleotide
  Target: FXN; (+) strand; PAM type: YTN; PAM sequence: CTG
gagcatttgctagtgacctt

SEQ ID NO: 30217 - DNA, 20 bp, Artificial Sequence
  Description of Artificial Sequence: Synthetic oligonucleotide
  Target: FXN; (+) strand; PAM type: YTN; PAM sequence: TTT
gctagtgacctttctatgcc

SEQ ID NO: 30218 - DNA, 20 bp, Artificial Sequence
  Description of Artificial Sequence: Synthetic oligonucleotide
  Target: FXN; (+) strand; PAM type: YTN; PAM sequence: TTG
ctagtgacctttctatgcca

SEQ ID NO: 30219 - DNA, 20 bp, Artificial Sequence
  Description of Artificial Sequence: Synthetic oligonucleotide
  Target: FXN; (+) strand; PAM type: YTN; PAM sequence: CTA
gtgacctttctatgccagaa

SEQ ID NO: 30220 - DNA, 20 bp, Artificial Sequence
  Description of Artificial Sequence: Synthetic oligonucleotide
  Target: FXN; (+) strand; PAM type: YTN; PAM sequence: CTT
tctatgccagaacttgctaa

SEQ ID NO: 30221 - DNA, 20 bp, Artificial Sequence
  Description of Artificial Sequence: Synthetic oligonucleotide
  Target: FXN; (+) strand; PAM type: YTN; PAM sequence: TTT
ctatgccagaacttgctaag

SEQ ID NO: 30222 - DNA, 20 bp, Artificial Sequence
  Description of Artificial Sequence: Synthetic oligonucleotide
  Target: FXN; (+) strand; PAM type: YTN; PAM sequence: TTC
tatgccagaacttgctaagc

SEQ ID NO: 30223 - DNA, 20 bp, Artificial Sequence
  Description of Artificial Sequence: Synthetic oligonucleotide
  Target: FXN; (+) strand; PAM type: YTN; PAM sequence: CTA
tgccagaacttgctaagcat

SEQ ID NO: 30224 - DNA, 20 bp, Artificial Sequence
  Description of Artificial Sequence: Synthetic oligonucleotide
  Target: FXN; (+) strand; PAM type: YTN; PAM sequence: CTT
gctaagcatgctagctaata

SEQ ID NO: 30225 - DNA, 20 bp, Artificial Sequence
  Description of Artificial Sequence: Synthetic oligonucleotide
  Target: FXN; (+) strand; PAM type: YTN; PAM sequence: TTG
ctaagcatgctagctaataa

SEQ ID NO: 30226 - DNA, 20 bp, Artificial Sequence
  Description of Artificial Sequence: Synthetic oligonucleotide
  Target: FXN; (+) strand; PAM type: YTN; PAM sequence: CTA
agcatgctagctaataatga

SEQ ID NO: 30227 - DNA, 20 bp, Artificial Sequence
  Description of Artificial Sequence: Synthetic oligonucleotide
  Target: FXN; (+) strand; PAM type: YTN; PAM sequence: CTA
gctaataatgatgtagcaca

SEQ ID NO: 30228 - DNA, 20 bp, Artificial Sequence
  Description of Artificial Sequence: Synthetic oligonucleotide
  Target: FXN; (+) strand; PAM type: YTN; PAM sequence: CTA
ataatgatgtagcacagggt

SEQ ID NO: 30229 - DNA, 20 bp, Artificial Sequence
  Description of Artificial Sequence: Synthetic oligonucleotide
  Target: FXN; (+) strand; PAM type: YTN; PAM sequence: CTC
acgcctgtaatctcagcact

SEQ ID NO: 30230 - DNA, 20 bp, Artificial Sequence
  Description of Artificial Sequence: Synthetic oligonucleotide
  Target: FXN; (+) strand; PAM type: YTN; PAM sequence: CTG
taatctcagcactttgggcg

SEQ ID NO: 30231 - DNA, 20 bp, Artificial Sequence
  Description of Artificial Sequence: Synthetic oligonucleotide
  Target: FXN; (+) strand; PAM type: YTN; PAM sequence: CTC
agcactttgggcggccgagg

SEQ ID NO: 30232 - DNA, 20 bp, Artificial Sequence
  Description of Artificial Sequence: Synthetic oligonucleotide
  Target: FXN; (+) strand; PAM type: YTN; PAM sequence: CTT
tgggcggccgaggcgggcgg

SEQ ID NO: 30233 - DNA, 20 bp, Artificial Sequence
  Description of Artificial Sequence: Synthetic oligonucleotide
  Target: FXN; (+) strand; PAM type: YTN; PAM sequence: TTT
gggcggccgaggcgggcgga

SEQ ID NO: 30234 - DNA, 20 bp, Artificial Sequence
  Description of Artificial Sequence: Synthetic oligonucleotide
  Target: FXN; (+) strand; PAM type: YTN; PAM sequence: TTG
ggcggccgaggcgggcggat

SEQ ID NO: 30235 - DNA, 20 bp, Artificial Sequence
  Description of Artificial Sequence: Synthetic oligonucleotide
  Target: FXN; (+) strand; PAM type: YTN; PAM sequence: CTG
aggtcaggagttcgagacca

SEQ ID NO: 30236 - DNA, 20 bp, Artificial Sequence
  Description of Artificial Sequence: Synthetic oligonucleotide
  Target: FXN; (+) strand; PAM type: YTN; PAM sequence: TTC
gagaccagcctggccaacat

SEQ ID NO: 30237 - DNA, 20 bp, Artificial Sequence
  Description of Artificial Sequence: Synthetic oligonucleotide
  Target: FXN; (+) strand; PAM type: YTN; PAM sequence: CTG
gccaacatgatgaaacccca

SEQ ID NO: 30238 - DNA, 20 bp, Artificial Sequence
  Description of Artificial Sequence: Synthetic oligonucleotide
  Target: FXN; (+) strand; PAM type: YTN; PAM sequence: CTC
tactaaaaatacaaaaatta

SEQ ID NO: 30239 - DNA, 20 bp, Artificial Sequence
  Description of Artificial Sequence: Synthetic oligonucleotide
  Target: FXN; (+) strand; PAM type: YTN; PAM sequence: CTA
ctaaaaatacaaaaattagc

SEQ ID NO: 30240 - DNA, 20 bp, Artificial Sequence
  Description of Artificial Sequence: Synthetic oligonucleotide
  Target: FXN; (+) strand; PAM type: YTN; PAM sequence: CTA
aaaatacaaaaattagccag

SEQ ID NO: 30241 - DNA, 20 bp, Artificial Sequence
  Description of Artificial Sequence: Synthetic oligonucleotide
  Target: FXN; (+) strand; PAM type: YTN; PAM sequence: TTA
gccaggcgtggtggtgggca

SEQ ID NO: 30242 - DNA, 20 bp, Artificial Sequence
  Description of Artificial Sequence: Synthetic oligonucleotide
  Target: FXN; (+) strand; PAM type: YTN; PAM sequence: CTG
caatcccagctactctggag

SEQ ID NO: 30243 - DNA, 20 bp, Artificial Sequence
  Description of Artificial Sequence: Synthetic oligonucleotide
  Target: FXN; (+) strand; PAM type: YTN; PAM sequence: CTA
ctctggaggctgagacagaa

SEQ ID NO: 30244 - DNA, 20 bp, Artificial Sequence
  Description of Artificial Sequence: Synthetic oligonucleotide
  Target: FXN; (+) strand; PAM type: YTN; PAM sequence: CTC
tggaggctgagacagaatct

SEQ ID NO: 30245 - DNA, 20 bp, Artificial Sequence
  Description of Artificial Sequence: Synthetic oligonucleotide
  Target: FXN; (+) strand; PAM type: YTN; PAM sequence: CTG
gaggctgagacagaatctct

SEQ ID NO: 30246 - DNA, 20 bp, Artificial Sequence
  Description of Artificial Sequence: Synthetic oligonucleotide
  Target: FXN; (+) strand; PAM type: YTN; PAM sequence: CTG
agacagaatctcttgaaccc

SEQ ID NO: 30247 - DNA, 20 bp, Artificial Sequence
  Description of Artificial Sequence: Synthetic oligonucleotide
  Target: FXN; (+) strand; PAM type: YTN; PAM sequence: CTC
ttgaacccaggaggtggaga

SEQ ID NO: 30248 - DNA, 20 bp, Artificial Sequence
  Description of Artificial Sequence: Synthetic oligonucleotide
  Target: FXN; (+) strand; PAM type: YTN; PAM sequence: CTT
gaacccaggaggtggagatt

SEQ ID NO: 30249 - DNA, 20 bp, Artificial Sequence
  Description of Artificial Sequence: Synthetic oligonucleotide
  Target: FXN; (+) strand; PAM type: YTN; PAM sequence: TTG
aacccaggaggtggagattg

SEQ ID NO: 30250 - DNA, 20 bp, Artificial Sequence
  Description of Artificial Sequence: Synthetic oligonucleotide
  Target: FXN; (+) strand; PAM type: YTN; PAM sequence: TTG
cagtgagcagagatggcacc

SEQ ID NO: 30251 - DNA, 20 bp, Artificial Sequence
  Description of Artificial Sequence: Synthetic oligonucleotide
  Target: FXN; (+) strand; PAM type: YTN; PAM sequence: CTG
cattccagcctgggcaacaa

SEQ ID NO: 30252 - DNA, 20 bp, Artificial Sequence
  Description of Artificial Sequence: Synthetic oligonucleotide
  Target: FXN; (+) strand; PAM type: YTN; PAM sequence: TTC
cagcctgggcaacaaagcaa

SEQ ID NO: 30253 - DNA, 20 bp, Artificial Sequence
  Description of Artificial Sequence: Synthetic oligonucleotide
  Target: FXN; (+) strand; PAM type: YTN; PAM sequence: CTG
ggcaacaaagcaagactctg

SEQ ID NO: 30254 - DNA, 20 bp, Artificial Sequence
  Description of Artificial Sequence: Synthetic oligonucleotide
  Target: FXN; (+) strand; PAM type: YTN; PAM sequence: CTC
tgtctcaaataataataata

SEQ ID NO: 30255 - DNA, 20 bp, Artificial Sequence
  Description of Artificial Sequence: Synthetic oligonucleotide
  Target: FXN; (+) strand; PAM type: YTN; PAM sequence: CTG
tctcaaataataataataat

SEQ ID NO: 30256 - DNA, 20 bp, Artificial Sequence
  Description of Artificial Sequence: Synthetic oligonucleotide
  Target: FXN; (+) strand; PAM type: YTN; PAM sequence: CTC
aaataataataataataata

SEQ ID NO: 30257 - DNA, 20 bp, Artificial Sequence
  Description of Artificial Sequence: Synthetic oligonucleotide
  Target: FXN; (+) strand; PAM type: YTN; PAM sequence: CTA
atgatgcagctttctctctc

SEQ ID NO: 30258 - DNA, 20 bp, Artificial Sequence
  Description of Artificial Sequence: Synthetic oligonucleotide
  Target: FXN; (+) strand; PAM type: YTN; PAM sequence: CTT
tctctctctgagtatataat

SEQ ID NO: 30259 - DNA, 20 bp, Artificial Sequence
  Description of Artificial Sequence: Synthetic oligonucleotide
  Target: FXN; (+) strand; PAM type: YTN; PAM sequence: TTT
ctctctctgagtatataatg

SEQ ID NO: 30260 - DNA, 20 bp, Artificial Sequence
  Description of Artificial Sequence: Synthetic oligonucleotide
  Target: FXN; (+) strand; PAM type: YTN; PAM sequence: TTC
tctctctgagtatataatgc

SEQ ID NO: 30261 - DNA, 20 bp, Artificial Sequence
  Description of Artificial Sequence: Synthetic oligonucleotide
  Target: FXN; (+) strand; PAM type: YTN; PAM sequence: CTC
tctctgagtatataatgcag

SEQ ID NO: 30262 - DNA, 20 bp, Artificial Sequence
  Description of Artificial Sequence: Synthetic oligonucleotide
  Target: FXN; (+) strand; PAM type: YTN; PAM sequence: CTC
tctgagtatataatgcagtt

SEQ ID NO: 30263 - DNA, 20 bp, Artificial Sequence
  Description of Artificial Sequence: Synthetic oligonucleotide
  Target: FXN; (+) strand; PAM type: YTN; PAM sequence: CTC
tgagtatataatgcagttct

SEQ ID NO: 30264 - DNA, 20 bp, Artificial Sequence
  Description of Artificial Sequence: Synthetic oligonucleotide
  Target: FXN; (+) strand; PAM type: YTN; PAM sequence: CTG
agtatataatgcagttctga

SEQ ID NO: 30265 - DNA, 20 bp, Artificial Sequence
  Description of Artificial Sequence: Synthetic oligonucleotide
  Target: FXN; (+) strand; PAM type: YTN; PAM sequence: TTC
tgatgatgtgaggaagggcc

SEQ ID NO: 30266 - DNA, 20 bp, Artificial Sequence
  Description of Artificial Sequence: Synthetic oligonucleotide
  Target: FXN; (+) strand; PAM type: YTN; PAM sequence: CTG
atgatgtgaggaagggcctc

SEQ ID NO: 30267 - DNA, 20 bp, Artificial Sequence
  Description of Artificial Sequence: Synthetic oligonucleotide
  Target: FXN; (+) strand; PAM type: YTN; PAM sequence: CTC
actgttggtgtggcagagtc

SEQ ID NO: 30268 - DNA, 20 bp, Artificial Sequence
  Description of Artificial Sequence: Synthetic oligonucleotide
  Target: FXN; (+) strand; PAM type: YTN; PAM sequence: CTG
ttggtgtggcagagtctgag

SEQ ID NO: 30269 - DNA, 20 bp, Artificial Sequence
  Description of Artificial Sequence: Synthetic oligonucleotide
  Target: FXN; (+) strand; PAM type: YTN; PAM sequence: TTG
gtgtggcagagtctgagacc

SEQ ID NO: 30270 - DNA, 20 bp, Artificial Sequence
  Description of Artificial Sequence: Synthetic oligonucleotide
  Target: FXN; (+) strand; PAM type: YTN; PAM sequence: CTG
agaccatggctggcaatgaa

SEQ ID NO: 30271 - DNA, 20 bp, Artificial Sequence
  Description of Artificial Sequence: Synthetic oligonucleotide
  Target: FXN; (+) strand; PAM type: YTN; PAM sequence: CTG
gcaatgaaaacactaccctt

SEQ ID NO: 30272 - DNA, 20 bp, Artificial Sequence
  Description of Artificial Sequence: Synthetic oligonucleotide
  Target: FXN; (+) strand; PAM type: YTN; PAM sequence: CTA
ccctttgatgcctatgggct

SEQ ID NO: 30273 - DNA, 20 bp, Artificial Sequence
  Description of Artificial Sequence: Synthetic oligonucleotide
  Target: FXN; (+) strand; PAM type: YTN; PAM sequence: CTT
tgatgcctatgggctctccc

SEQ ID NO: 30274 - DNA, 20 bp, Artificial Sequence
  Description of Artificial Sequence: Synthetic oligonucleotide
  Target: FXN; (+) strand; PAM type: YTN; PAM sequence: TTT
gatgcctatgggctctccct

SEQ ID NO: 30275 - DNA, 20 bp, Artificial Sequence
  Description of Artificial Sequence: Synthetic oligonucleotide
  Target: FXN; (+) strand; PAM type: YTN; PAM sequence: TTG
atgcctatgggctctccctt

SEQ ID NO: 30276 - DNA, 20 bp, Artificial Sequence
  Description of Artificial Sequence: Synthetic oligonucleotide
  Target: FXN; (+) strand; PAM type: YTN; PAM sequence: CTA
tgggctctccctttatggtt

SEQ ID NO: 30277 - DNA, 20 bp, Artificial Sequence
  Description of Artificial Sequence: Synthetic oligonucleotide
  Target: FXN; (+) strand; PAM type: YTN; PAM sequence: CTC
tccctttatggtttcaagga

SEQ ID NO: 30278 - DNA, 20 bp, Artificial Sequence
  Description of Artificial Sequence: Synthetic oligonucleotide
  Target: FXN; (+) strand; PAM type: YTN; PAM sequence: CTC
cctttatggtttcaaggagg

SEQ ID NO: 30279 - DNA, 20 bp, Artificial Sequence
  Description of Artificial Sequence: Synthetic oligonucleotide
  Target: FXN; (+) strand; PAM type: YTN; PAM sequence: CTT
tatggtttcaaggagggctt

SEQ ID NO: 30280 - DNA, 20 bp, Artificial Sequence
  Description of Artificial Sequence: Synthetic oligonucleotide
  Target: FXN; (+) strand; PAM type: YTN; PAM sequence: TTT
atggtttcaaggagggcttc

SEQ ID NO: 30281 - DNA, 20 bp, Artificial Sequence
  Description of Artificial Sequence: Synthetic oligonucleotide
  Target: FXN; (+) strand; PAM type: YTN; PAM sequence: TTA
tggtttcaaggagggcttct

SEQ ID NO: 30282 - DNA, 20 bp, Artificial Sequence
  Description of Artificial Sequence: Synthetic oligonucleotide
  Target: FXN; (+) strand; PAM type: YTN; PAM sequence: TTT
caaggagggcttctcaatct

SEQ ID NO: 30283 - DNA, 20 bp, Artificial Sequence
  Description of Artificial Sequence: Synthetic oligonucleotide
  Target: FXN; (+) strand; PAM type: YTN; PAM sequence: TTC
aaggagggcttctcaatctt

SEQ ID NO: 30284 - DNA, 20 bp, Artificial Sequence
  Description of Artificial Sequence: Synthetic oligonucleotide
  Target: FXN; (+) strand; PAM type: YTN; PAM sequence: CTT
ctcaatcttggcagaatttt

SEQ ID NO: 30285 - DNA, 20 bp, Artificial Sequence
  Description of Artificial Sequence: Synthetic oligonucleotide
  Target: FXN; (+) strand; PAM type: YTN; PAM sequence: TTC
tcaatcttggcagaattttg

SEQ ID NO: 30286 - DNA, 20 bp, Artificial Sequence
  Description of Artificial Sequence: Synthetic oligonucleotide
  Target: FXN; (+) strand; PAM type: YTN; PAM sequence: CTC
aatcttggcagaattttgga

SEQ ID NO: 30287 - DNA, 20 bp, Artificial Sequence
  Description of Artificial Sequence: Synthetic oligonucleotide
  Target: FXN; (+) strand; PAM type: YTN; PAM sequence: CTT
ggcagaattttggactggat

SEQ ID NO: 30288 - DNA, 20 bp, Artificial Sequence
  Description of Artificial Sequence: Synthetic oligonucleotide
  Target: FXN; (+) strand; PAM type: YTN; PAM sequence: TTG
gcagaattttggactggata

SEQ ID NO: 30289 - DNA, 20 bp, Artificial Sequence
  Description of Artificial Sequence: Synthetic oligonucleotide
  Target: FXN; (+) strand; PAM type: YTN; PAM sequence: TTT
tggactggatagttctttgt

SEQ ID NO: 30290 - DNA, 20 bp, Artificial Sequence
  Description of Artificial Sequence: Synthetic oligonucleotide
  Target: FXN; (+) strand; PAM type: YTN; PAM sequence: TTT
ggactggatagttctttgtt

SEQ ID NO: 30291 - DNA, 20 bp, Artificial Sequence
  Description of Artificial Sequence: Synthetic oligonucleotide
  Target: FXN; (+) strand; PAM type: YTN; PAM sequence: TTG
gactggatagttctttgttg

SEQ ID NO: 30292 - DNA, 20 bp, Artificial Sequence
  Description of Artificial Sequence: Synthetic oligonucleotide
  Target: FXN; (+) strand; PAM type: YTN; PAM sequence: CTG
gatagttctttgttgcacag

SEQ ID NO: 30293 - DNA, 20 bp, Artificial Sequence
  Description of Artificial Sequence: Synthetic oligonucleotide
  Target: FXN; (+) strand; PAM type: YTN; PAM sequence: TTC
tttgttgcacaggtgggggg

SEQ ID NO: 30294 - DNA, 20 bp, Artificial Sequence
  Description of Artificial Sequence: Synthetic oligonucleotide
  Target: FXN; (+) strand; PAM type: YTN; PAM sequence: CTT
tgttgcacaggtggggggct

SEQ ID NO: 30295 - DNA, 20 bp, Artificial Sequence
  Description of Artificial Sequence: Synthetic oligonucleotide
  Target: FXN; (+) strand; PAM type: YTN; PAM sequence: TTT
gttgcacaggtggggggctg

SEQ ID NO: 30296 - DNA, 20 bp, Artificial Sequence
  Description of Artificial Sequence: Synthetic oligonucleotide
  Target: FXN; (+) strand; PAM type: YTN; PAM sequence: TTG
ttgcacaggtggggggctgt

SEQ ID NO: 30297 - DNA, 20 bp, Artificial Sequence
  Description of Artificial Sequence: Synthetic oligonucleotide
  Target: FXN; (+) strand; PAM type: YTN; PAM sequence: TTG
cacaggtggggggctgtcct

SEQ ID NO: 30298 - DNA, 20 bp, Artificial Sequence
  Description of Artificial Sequence: Synthetic oligonucleotide
  Target: FXN; (+) strand; PAM type: YTN; PAM sequence: CTG
tcctgcacatcacaggatgt

SEQ ID NO: 30299 - DNA, 20 bp, Artificial Sequence
  Description of Artificial Sequence: Synthetic oligonucleotide
  Target: FXN; (+) strand; PAM type: YTN; PAM sequence: CTG
cacatcacaggatgtttcat

SEQ ID NO: 30300 - DNA, 20 bp, Artificial Sequence
  Description of Artificial Sequence: Synthetic oligonucleotide
  Target: FXN; (+) strand; PAM type: YTN; PAM sequence: TTT
catccctggcctctacctac

SEQ ID NO: 30301 - DNA, 20 bp, Artificial Sequence
  Description of Artificial Sequence: Synthetic oligonucleotide
  Target: FXN; (+) strand; PAM type: YTN; PAM sequence: TTC
atccctggcctctacctact

SEQ ID NO: 30302 - DNA, 20 bp, Artificial Sequence
  Description of Artificial Sequence: Synthetic oligonucleotide
  Target: FXN; (+) strand; PAM type: YTN; PAM sequence: CTG
gcctctacctactagatgcc

SEQ ID NO: 30303 - DNA, 20 bp, Artificial Sequence
  Description of Artificial Sequence: Synthetic oligonucleotide
  Target: FXN; (+) strand; PAM type: YTN; PAM sequence: CTC
tacctactagatgccagtag

SEQ ID NO: 30304 - DNA, 20 bp, Artificial Sequence
  Description of Artificial Sequence: Synthetic oligonucleotide
  Target: FXN; (+) strand; PAM type: YTN; PAM sequence: CTA
cctactagatgccagtagaa

SEQ ID NO: 30305 - DNA, 20 bp, Artificial Sequence
  Description of Artificial Sequence: Synthetic oligonucleotide
  Target: FXN; (+) strand; PAM type: YTN; PAM sequence: CTA
ctagatgccagtagaacata

SEQ ID NO: 30306 - DNA, 20 bp, Artificial Sequence
  Description of Artificial Sequence: Synthetic oligonucleotide
  Target: FXN; (+) strand; PAM type: YTN; PAM sequence: CTA
gatgccagtagaacataccc

SEQ ID NO: 30307 - DNA, 20 bp, Artificial Sequence
  Description of Artificial Sequence: Synthetic oligonucleotide
  Target: FXN; (+) strand; PAM type: YTN; PAM sequence: CTG
cctgttgtgacaatcaaaag

SEQ ID NO: 30308 - DNA, 20 bp, Artificial Sequence
  Description of Artificial Sequence: Synthetic oligonucleotide
  Target: FXN; (+) strand; PAM type: YTN; PAM sequence: CTG
ttgtgacaatcaaaagcatc

SEQ ID NO: 30309 - DNA, 20 bp, Artificial Sequence
  Description of Artificial Sequence: Synthetic oligonucleotide
  Target: FXN; (+) strand; PAM type: YTN; PAM sequence: TTG
tgacaatcaaaagcatctcc

SEQ ID NO: 30310 - DNA, 20 bp, Artificial Sequence
  Description of Artificial Sequence: Synthetic oligonucleotide
  Target: FXN; (+) strand; PAM type: YTN; PAM sequence: CTC
cagatactttgcagggggaa

SEQ ID NO: 30311 - DNA, 20 bp, Artificial Sequence
  Description of Artificial Sequence: Synthetic oligonucleotide
  Target: FXN; (+) strand; PAM type: YTN; PAM sequence: CTT
tgcagggggaaaatgatttc

SEQ ID NO: 30312 - DNA, 20 bp, Artificial Sequence
  Description of Artificial Sequence: Synthetic oligonucleotide
  Target: FXN; (+) strand; PAM type: YTN; PAM sequence: TTT
gcagggggaaaatgatttct

SEQ ID NO: 30313 - DNA, 20 bp, Artificial Sequence
  Description of Artificial Sequence: Synthetic oligonucleotide
  Target: FXN; (+) strand; PAM type: YTN; PAM sequence: TTG
cagggggaaaatgatttctc

SEQ ID NO: 30314 - DNA, 20 bp, Artificial Sequence
  Description of Artificial Sequence: Synthetic oligonucleotide
  Target: FXN; (+) strand; PAM type: YTN; PAM sequence: TTT
ctccaggcctggcatataca

SEQ ID NO: 30315 - DNA, 20 bp, Artificial Sequence
  Description of Artificial Sequence: Synthetic oligonucleotide
  Target: FXN; (+) strand; PAM type: YTN; PAM sequence: TTC
tccaggcctggcatatacat

SEQ ID NO: 30316 - DNA, 20 bp, Artificial Sequence
  Description of Artificial Sequence: Synthetic oligonucleotide
  Target: FXN; (+) strand; PAM type: YTN; PAM sequence: CTC
caggcctggcatatacataa

SEQ ID NO: 30317 - DNA, 20 bp, Artificial Sequence
  Description of Artificial Sequence: Synthetic oligonucleotide
  Target: FXN; (+) strand; PAM type: YTN; PAM sequence: CTG
gcatatacataacagtattt

SEQ ID NO: 30318 - DNA, 20 bp, Artificial Sequence
  Description of Artificial Sequence: Synthetic oligonucleotide
  Target: FXN; (+) strand; PAM type: YTN; PAM sequence: TTT
aagcagctgcctagaattaa

SEQ ID NO: 30319 - DNA, 20 bp, Artificial Sequence
  Description of Artificial Sequence: Synthetic oligonucleotide
  Target: FXN; (+) strand; PAM type: YTN; PAM sequence: TTA
agcagctgcctagaattaat

SEQ ID NO: 30320 - DNA, 20 bp, Artificial Sequence
  Description of Artificial Sequence: Synthetic oligonucleotide
  Target: FXN; (+) strand; PAM type: YTN; PAM sequence: CTG
cctagaattaattaaacaca

SEQ ID NO: 30321 - DNA, 20 bp, Artificial Sequence
  Description of Artificial Sequence: Synthetic oligonucleotide
  Target: FXN; (+) strand; PAM type: YTN; PAM sequence: CTA
gaattaattaaacacagaag

SEQ ID NO: 30322 - DNA, 20 bp, Artificial Sequence
  Description of Artificial Sequence: Synthetic oligonucleotide
  Target: FXN; (+) strand; PAM type: YTN; PAM sequence: TTA
attaaacacagaaggatgtc

SEQ ID NO: 30323 - DNA, 20 bp, Artificial Sequence
  Description of Artificial Sequence: Synthetic oligonucleotide
  Target: FXN; (+) strand; PAM type: YTN; PAM sequence: TTA
aacacagaaggatgtctctc

SEQ ID NO: 30324 - DNA, 20 bp, Artificial Sequence
  Description of Artificial Sequence: Synthetic oligonucleotide
  Target: FXN; (+) strand; PAM type: YTN; PAM sequence: CTC
tcatccagaatgccctggac

SEQ ID NO: 30325 - DNA, 20 bp, Artificial Sequence
  Description of Artificial Sequence: Synthetic oligonucleotide
  Target: FXN; (+) strand; PAM type: YTN; PAM sequence: CTC
atccagaatgccctggacca

SEQ ID NO: 30326 - DNA, 20 bp, Artificial Sequence
  Description of Artificial Sequence: Synthetic oligonucleotide
  Target: FXN; (+) strand; PAM type: YTN; PAM sequence: CTG
gaccacctctttgataggca

SEQ ID NO: 30327 - DNA, 20 bp, Artificial Sequence
  Description of Artificial Sequence: Synthetic oligonucleotide
  Target: FXN; (+) strand; PAM type: YTN; PAM sequence: CTC
tttgataggcaatcagatcc

SEQ ID NO: 30328 - DNA, 20 bp, Artificial Sequence
  Description of Artificial Sequence: Synthetic oligonucleotide
  Target: FXN; (+) strand; PAM type: YTN; PAM sequence: CTT
tgataggcaatcagatccca

SEQ ID NO: 30329 - DNA, 20 bp, Artificial Sequence
  Description of Artificial Sequence: Synthetic oligonucleotide
  Target: FXN; (+) strand; PAM type: YTN; PAM sequence: TTT
gataggcaatcagatcccac

SEQ ID NO: 30330 - DNA, 20 bp, Artificial Sequence
  Description of Artificial Sequence: Synthetic oligonucleotide
  Target: FXN; (+) strand; PAM type: YTN; PAM sequence: TTG
ataggcaatcagatcccacc

SEQ ID NO: 30331 - DNA, 20 bp, Artificial Sequence
  Description of Artificial Sequence: Synthetic oligonucleotide
  Target: FXN; (+) strand; PAM type: YTN; PAM sequence: CTC
ctccaccctatttttgaagg

SEQ ID NO: 30332 - DNA, 20 bp, Artificial Sequence
  Description of Artificial Sequence: Synthetic oligonucleotide
  Target: FXN; (+) strand; PAM type: YTN; PAM sequence: CTC
caccctatttttgaaggccc

SEQ ID NO: 30333 - DNA, 20 bp, Artificial Sequence
  Description of Artificial Sequence: Synthetic oligonucleotide
  Target: FXN; (+) strand; PAM type: YTN; PAM sequence: CTA
tttttgaaggccctgtgcca

SEQ ID NO: 30334 - DNA, 20 bp, Artificial Sequence
  Description of Artificial Sequence: Synthetic oligonucleotide
  Target: FXN; (+) strand; PAM type: YTN; PAM sequence: TTT
ttgaaggccctgtgccaaca

SEQ ID NO: 30335 - DNA, 20 bp, Artificial Sequence
  Description of Artificial Sequence: Synthetic oligonucleotide
  Target: FXN; (+) strand; PAM type: YTN; PAM sequence: TTT
tgaaggccctgtgccaacac

SEQ ID NO: 30336 - DNA, 20 bp, Artificial Sequence
  Description of Artificial Sequence: Synthetic oligonucleotide
  Target: FXN; (+) strand; PAM type: YTN; PAM sequence: TTT
gaaggccctgtgccaacacc

SEQ ID NO: 30337 - DNA, 20 bp, Artificial Sequence
  Description of Artificial Sequence: Synthetic oligonucleotide
  Target: FXN; (+) strand; PAM type: YTN; PAM sequence: TTG
aaggccctgtgccaacacca

SEQ ID NO: 30338 - DNA, 20 bp, Artificial Sequence
  Description of Artificial Sequence: Synthetic oligonucleotide
  Target: FXN; (+) strand; PAM type: YTN; PAM sequence: CTG
tgccaacaccacttcttcca

SEQ ID NO: 30339 - DNA, 20 bp, Artificial Sequence
  Description of Artificial Sequence: Synthetic oligonucleotide
  Target: FXN; (+) strand; PAM type: YTN; PAM sequence: CTT
cttccatgaatacttccttg

SEQ ID NO: 30340 - DNA, 20 bp, Artificial Sequence
  Description of Artificial Sequence: Synthetic oligonucleotide
  Target: FXN; (+) strand; PAM type: YTN; PAM sequence: TTC
ttccatgaatacttccttga

SEQ ID NO: 30341 - DNA, 20 bp, Artificial Sequence
  Description of Artificial Sequence: Synthetic oligonucleotide
  Target: FXN; (+) strand; PAM type: YTN; PAM sequence: CTT
ccatgaatacttccttgatt

SEQ ID NO: 30342 - DNA, 20 bp, Artificial Sequence
  Description of Artificial Sequence: Synthetic oligonucleotide
  Target: FXN; (+) strand; PAM type: YTN; PAM sequence: TTC
catgaatacttccttgattc

SEQ ID NO: 30343 - DNA, 20 bp, Artificial Sequence
  Description of Artificial Sequence: Synthetic oligonucleotide
  Target: FXN; (+) strand; PAM type: YTN; PAM sequence: CTT
ccttgattcccccatcccta

SEQ ID NO: 30344 - DNA, 20 bp, Artificial Sequence
  Description of Artificial Sequence: Synthetic oligonucleotide
  Target: FXN; (+) strand; PAM type: YTN; PAM sequence: TTC
cttgattcccccatccctag

SEQ ID NO: 30345 - DNA, 20 bp, Artificial Sequence
  Description of Artificial Sequence: Synthetic oligonucleotide
  Target: FXN; (+) strand; PAM type: YTN; PAM sequence: CTT
gattcccccatccctagctc

SEQ ID NO: 30346 - DNA, 20 bp, Artificial Sequence
  Description of Artificial Sequence: Synthetic oligonucleotide
  Target: FXN; (+) strand; PAM type: YTN; PAM sequence: TTG
attcccccatccctagctct

SEQ ID NO: 30347 - DNA, 20 bp, Artificial Sequence
  Description of Artificial Sequence: Synthetic oligonucleotide
  Target: FXN; (+) strand; PAM type: YTN; PAM sequence: TTC
ccccatccctagctctatat

SEQ ID NO: 30348 - DNA, 20 bp, Artificial Sequence
  Description of Artificial Sequence: Synthetic oligonucleotide
  Target: FXN; (+) strand; PAM type: YTN; PAM sequence: CTA
gctctatataaatctcccac

SEQ ID NO: 30349 - DNA, 20 bp, Artificial Sequence
  Description of Artificial Sequence: Synthetic oligonucleotide
  Target: FXN; (+) strand; PAM type: YTN; PAM sequence: CTC
tatataaatctcccactcaa

SEQ ID NO: 30350 - DNA, 20 bp, Artificial Sequence
  Description of Artificial Sequence: Synthetic oligonucleotide
  Target: FXN; (+) strand; PAM type: YTN; PAM sequence: CTA
tataaatctcccactcaaca

SEQ ID NO: 30351 - DNA, 20 bp, Artificial Sequence
  Description of Artificial Sequence: Synthetic oligonucleotide
  Target: FXN; (+) strand; PAM type: YTN; PAM sequence: CTC
ccactcaacactcacacctg

SEQ ID NO: 30352 - DNA, 20 bp, Artificial Sequence
  Description of Artificial Sequence: Synthetic oligonucleotide
  Target: FXN; (+) strand; PAM type: YTN; PAM sequence: CTC
aacactcacacctgttagtt

SEQ ID NO: 30353 - DNA, 20 bp, Artificial Sequence
  Description of Artificial Sequence: Synthetic oligonucleotide
  Target: FXN; (+) strand; PAM type: YTN; PAM sequence: CTC
acacctgttagtttacattc

SEQ ID NO: 30354 - DNA, 20 bp, Artificial Sequence
  Description of Artificial Sequence: Synthetic oligonucleotide
  Target: FXN; (+) strand; PAM type: YTN; PAM sequence: CTG
ttagtttacattcctcttga

SEQ ID NO: 30355 - DNA, 20 bp, Artificial Sequence
  Description of Artificial Sequence: Synthetic oligonucleotide
  Target: FXN; (+) strand; PAM type: YTN; PAM sequence: TTA
gtttacattcctcttgacac

SEQ ID NO: 30356 - DNA, 20 bp, Artificial Sequence
  Description of Artificial Sequence: Synthetic oligonucleotide
  Target: FXN; (+) strand; PAM type: YTN; PAM sequence: TTT
acattcctcttgacacttgt

SEQ ID NO: 30357 - DNA, 20 bp, Artificial Sequence
  Description of Artificial Sequence: Synthetic oligonucleotide
  Target: FXN; (+) strand; PAM type: YTN; PAM sequence: TTA
cattcctcttgacacttgtc

SEQ ID NO: 30358 - DNA, 20 bp, Artificial Sequence
  Description of Artificial Sequence: Synthetic oligonucleotide
  Target: FXN; (+) strand; PAM type: YTN; PAM sequence: TTC
ctcttgacacttgtcattta

SEQ ID NO: 30359 - DNA, 20 bp, Artificial Sequence
  Description of Artificial Sequence: Synthetic oligonucleotide
  Target: FXN; (+) strand; PAM type: YTN; PAM sequence: CTC
ttgacacttgtcatttagca

SEQ ID NO: 30360 - DNA, 20 bp, Artificial Sequence
  Description of Artificial Sequence: Synthetic oligonucleotide
  Target: FXN; (+) strand; PAM type: YTN; PAM sequence: CTT
gacacttgtcatttagcatc

SEQ ID NO: 30361 - DNA, 20 bp, Artificial Sequence
  Description of Artificial Sequence: Synthetic oligonucleotide
  Target: FXN; (+) strand; PAM type: YTN; PAM sequence: TTG
acacttgtcatttagcatcc

SEQ ID NO: 30362 - DNA, 20 bp, Artificial Sequence
  Description of Artificial Sequence: Synthetic oligonucleotide
  Target: FXN; (+) strand; PAM type: YTN; PAM sequence: CTT
gtcatttagcatcctaagta

SEQ ID NO: 30363 - DNA, 20 bp, Artificial Sequence
  Description of Artificial Sequence: Synthetic oligonucleotide
  Target: FXN; (+) strand; PAM type: YTN; PAM sequence: TTG
tcatttagcatcctaagtat

SEQ ID NO: 30364 - DNA, 20 bp, Artificial Sequence
  Description of Artificial Sequence: Synthetic oligonucleotide
  Target: FXN; (+) strand; PAM type: YTN; PAM sequence: TTT
agcatcctaagtatgtaaac

SEQ ID NO: 30365 - DNA, 20 bp, Artificial Sequence
  Description of Artificial Sequence: Synthetic oligonucleotide
  Target: FXN; (+) strand; PAM type: YTN; PAM sequence: TTA
gcatcctaagtatgtaaaca

SEQ ID NO: 30366 - DNA, 20 bp, Artificial Sequence
  Description of Artificial Sequence: Synthetic oligonucleotide
  Target: FXN; (+) strand; PAM type: YTN; PAM sequence: CTA
agtatgtaaacatgtctctc

SEQ ID NO: 30367 - DNA, 20 bp, Artificial Sequence
  Description of Artificial Sequence: Synthetic oligonucleotide
  Target: FXN; (+) strand; PAM type: YTN; PAM sequence: CTC
tcttcacgattcacaaagtg

SEQ ID NO: 30368 - DNA, 20 bp, Artificial Sequence
  Description of Artificial Sequence: Synthetic oligonucleotide
  Target: FXN; (+) strand; PAM type: YTN; PAM sequence: CTC
ttcacgattcacaaagtggc

SEQ ID NO: 30369 - DNA, 20 bp, Artificial Sequence
  Description of Artificial Sequence: Synthetic oligonucleotide
  Target: FXN; (+) strand; PAM type: YTN; PAM sequence: CTT
cacgattcacaaagtggctt

SEQ ID NO: 30370 - DNA, 20 bp, Artificial Sequence
  Description of Artificial Sequence: Synthetic oligonucleotide
  Target: FXN; (+) strand; PAM type: YTN; PAM sequence: TTC
acgattcacaaagtggcttt

SEQ ID NO: 30371 - DNA, 20 bp, Artificial Sequence
  Description of Artificial Sequence: Synthetic oligonucleotide
  Target: FXN; (+) strand; PAM type: YTN; PAM sequence: TTC
acaaagtggctttggaagaa

SEQ ID NO: 30372 - DNA, 20 bp, Artificial Sequence
  Description of Artificial Sequence: Synthetic oligonucleotide
  Target: FXN; (+) strand; PAM type: YTN; PAM sequence: CTT
tggaagaactttagtacctt

SEQ ID NO: 30373 - DNA, 20 bp, Artificial Sequence
  Description of Artificial Sequence: Synthetic oligonucleotide
  Target: FXN; (+) strand; PAM type: YTN; PAM sequence: TTT
ggaagaactttagtaccttc

SEQ ID NO: 30374 - DNA, 20 bp, Artificial Sequence
  Description of Artificial Sequence: Synthetic oligonucleotide
  Target: FXN; (+) strand; PAM type: YTN; PAM sequence: TTG
gaagaactttagtaccttcc

SEQ ID NO: 30375 - DNA, 20 bp, Artificial Sequence
  Description of Artificial Sequence: Synthetic oligonucleotide
  Target: FXN; (+) strand; PAM type: YTN; PAM sequence: CTT
tagtaccttcccatcttctc

SEQ ID NO: 30376 - DNA, 20 bp, Artificial Sequence
  Description of Artificial Sequence: Synthetic oligonucleotide
  Target: FXN; (+) strand; PAM type: YTN; PAM sequence: TTT
agtaccttcccatcttctct

SEQ ID NO: 30377 - DNA, 20 bp, Artificial Sequence
  Description of Artificial Sequence: Synthetic oligonucleotide
  Target: FXN; (+) strand; PAM type: YTN; PAM sequence: TTA
gtaccttcccatcttctctg

SEQ ID NO: 30378 - DNA, 20 bp, Artificial Sequence
  Description of Artificial Sequence: Synthetic oligonucleotide
  Target: FXN; (+) strand; PAM type: YTN; PAM sequence: CTT
cccatcttctctgccatgga

SEQ ID NO: 30379 - DNA, 20 bp, Artificial Sequence
  Description of Artificial Sequence: Synthetic oligonucleotide
  Target: FXN; (+) strand; PAM type: YTN; PAM sequence: TTC
ccatcttctctgccatggaa

SEQ ID NO: 30380 - DNA, 20 bp, Artificial Sequence
  Description of Artificial Sequence: Synthetic oligonucleotide
  Target: FXN; (+) strand; PAM type: YTN; PAM sequence: CTT
ctctgccatggaaagtgtac

SEQ ID NO: 30381 - DNA, 20 bp, Artificial Sequence
  Description of Artificial Sequence: Synthetic oligonucleotide
  Target: FXN; (+) strand; PAM type: YTN; PAM sequence: TTC
tctgccatggaaagtgtaca

SEQ ID NO: 30382 - DNA, 20 bp, Artificial Sequence
  Description of Artificial Sequence: Synthetic oligonucleotide
  Target: FXN; (+) strand; PAM type: YTN; PAM sequence: CTC
tgccatggaaagtgtacaca

SEQ ID NO: 30383 - DNA, 20 bp, Artificial Sequence
  Description of Artificial Sequence: Synthetic oligonucleotide
  Target: FXN; (+) strand; PAM type: YTN; PAM sequence: CTG
ccatggaaagtgtacacaac

SEQ ID NO: 30384 - DNA, 20 bp, Artificial Sequence
  Description of Artificial Sequence: Synthetic oligonucleotide
  Target: FXN; (+) strand; PAM type: YTN; PAM sequence: CTG
acattttctttttttttaag

SEQ ID NO: 30385 - DNA, 20 bp, Artificial Sequence
  Description of Artificial Sequence: Synthetic oligonucleotide
  Target: FXN; (+) strand; PAM type: YTN; PAM sequence: TTT
tctttttttttaagacagta

SEQ ID NO: 30386 - DNA, 20 bp, Artificial Sequence
  Description of Artificial Sequence: Synthetic oligonucleotide
  Target: FXN; (+) strand; PAM type: YTN; PAM sequence: TTT
ctttttttttaagacagtat

SEQ ID NO: 30387 - DNA, 20 bp, Artificial Sequence
  Description of Artificial Sequence: Synthetic oligonucleotide
  Target: FXN; (+) strand; PAM type: YTN; PAM sequence: TTC
tttttttttaagacagtatc

SEQ ID NO: 30388 - DNA, 20 bp, Artificial Sequence
  Description of Artificial Sequence: Synthetic oligonucleotide
  Target: FXN; (+) strand; PAM type: YTN; PAM sequence: CTT
tttttttaagacagtatctt

SEQ ID NO: 30389 - DNA, 20 bp, Artificial Sequence
  Description of Artificial Sequence: Synthetic oligonucleotide
  Target: FXN; (+) strand; PAM type: YTN; PAM sequence: TTT
ttttttaagacagtatcttg

SEQ ID NO: 30390 - DNA, 20 bp, Artificial Sequence
  Description of Artificial Sequence: Synthetic oligonucleotide
  Target: FXN; (+) strand; PAM type: YTN; PAM sequence: TTT
tttttaagacagtatcttgc

SEQ ID NO: 30391 - DNA, 20 bp, Artificial Sequence
  Description of Artificial Sequence: Synthetic oligonucleotide
  Target: FXN; (+) strand; PAM type: YTN; PAM sequence: TTT
ttttaagacagtatcttgct

SEQ ID NO: 30392 - DNA, 20 bp, Artificial Sequence
  Description of Artificial Sequence: Synthetic oligonucleotide
  Target: FXN; (+) strand; PAM type: YTN; PAM sequence: TTT
tttaagacagtatcttgcta

SEQ ID NO: 30393 - DNA, 20 bp, Artificial Sequence
  Description of Artificial Sequence: Synthetic oligonucleotide
  Target: FXN; (+) strand; PAM type: YTN; PAM sequence: TTT
ttaagacagtatcttgctat

SEQ ID NO: 30394 - DNA, 20 bp, Artificial Sequence
  Description of Artificial Sequence: Synthetic oligonucleotide
  Target: FXN; (+) strand; PAM type: YTN; PAM sequence: TTT
taagacagtatcttgctatg

SEQ ID NO: 30395 - DNA, 20 bp, Artificial Sequence
  Description of Artificial Sequence: Synthetic oligonucleotide
  Target: FXN; (+) strand; PAM type: YTN; PAM sequence: TTT
aagacagtatcttgctatga

SEQ ID NO: 30396 - DNA, 20 bp, Artificial Sequence
  Description of Artificial Sequence: Synthetic oligonucleotide
  Target: FXN; (+) strand; PAM type: YTN; PAM sequence: TTA
agacagtatcttgctatgat

SEQ ID NO: 30397 - DNA, 20 bp, Artificial Sequence
  Description of Artificial Sequence: Synthetic oligonucleotide
  Target: FXN; (+) strand; PAM type: YTN; PAM sequence: CTT
gctatgatggccgggctgga

SEQ ID NO: 30398 - DNA, 20 bp, Artificial Sequence
  Description of Artificial Sequence: Synthetic oligonucleotide
  Target: FXN; (+) strand; PAM type: YTN; PAM sequence: TTG
ctatgatggccgggctggaa

SEQ ID NO: 30399 - DNA, 20 bp, Artificial Sequence
  Description of Artificial Sequence: Synthetic oligonucleotide
  Target: FXN; (+) strand; PAM type: YTN; PAM sequence: CTA
tgatggccgggctggaatgc

SEQ ID NO: 30400 - DNA, 20 bp, Artificial Sequence
  Description of Artificial Sequence: Synthetic oligonucleotide
  Target: FXN; (+) strand; PAM type: YTN; PAM sequence: CTG
gaatgctgtggctattcaca

SEQ ID NO: 30401 - DNA, 20 bp, Artificial Sequence
  Description of Artificial Sequence: Synthetic oligonucleotide
  Target: FXN; (+) strand; PAM type: YTN; PAM sequence: CTG
tggctattcacaggcacaat

SEQ ID NO: 30402 - DNA, 20 bp, Artificial Sequence
  Description of Artificial Sequence: Synthetic oligonucleotide
  Target: FXN; (+) strand; PAM type: YTN; PAM sequence: CTA
ttcacaggcacaatcatagc

SEQ ID NO: 30403 - DNA, 20 bp, Artificial Sequence
  Description of Artificial Sequence: Synthetic oligonucleotide
  Target: FXN; (+) strand; PAM type: YTN; PAM sequence: TTC
acaggcacaatcatagctca

SEQ ID NO: 30404 - DNA, 20 bp, Artificial Sequence
  Description of Artificial Sequence: Synthetic oligonucleotide
  Target: FXN; (+) strand; PAM type: YTN; PAM sequence: CTC
actgcagccttgagctccca

SEQ ID NO: 30405 - DNA, 20 bp, Artificial Sequence
  Description of Artificial Sequence: Synthetic oligonucleotide
  Target: FXN; (+) strand; PAM type: YTN; PAM sequence: CTG
cagccttgagctcccaggct

SEQ ID NO: 30406 - DNA, 20 bp, Artificial Sequence
  Description of Artificial Sequence: Synthetic oligonucleotide
  Target: FXN; (+) strand; PAM type: YTN; PAM sequence: CTT
gagctcccaggctcaagtga

SEQ ID NO: 30407 - DNA, 20 bp, Artificial Sequence
  Description of Artificial Sequence: Synthetic oligonucleotide
  Target: FXN; (+) strand; PAM type: YTN; PAM sequence: TTG
agctcccaggctcaagtgat

SEQ ID NO: 30408 - DNA, 20 bp, Artificial Sequence
  Description of Artificial Sequence: Synthetic oligonucleotide
  Target: FXN; (+) strand; PAM type: YTN; PAM sequence: CTC
ccaggctcaagtgatcctcc

SEQ ID NO: 30409 - DNA, 20 bp, Artificial Sequence
  Description of Artificial Sequence: Synthetic oligonucleotide
  Target: FXN; (+) strand; PAM type: YTN; PAM sequence: CTC
aagtgatcctcccgcctcag

SEQ ID NO: 30410 - DNA, 20 bp, Artificial Sequence
  Description of Artificial Sequence: Synthetic oligonucleotide
  Target: FXN; (+) strand; PAM type: YTN; PAM sequence: CTC
ccgcctcagcctcctgagta

SEQ ID NO: 30411 - DNA, 20 bp, Artificial Sequence
  Description of Artificial Sequence: Synthetic oligonucleotide
  Target: FXN; (+) strand; PAM type: YTN; PAM sequence: CTC
agcctcctgagtagctgaga

SEQ ID NO: 30412 - DNA, 20 bp, Artificial Sequence
  Description of Artificial Sequence: Synthetic oligonucleotide
  Target: FXN; (+) strand; PAM type: YTN; PAM sequence: CTC
ctgagtagctgagatcacag

SEQ ID NO: 30413 - DNA, 20 bp, Artificial Sequence
  Description of Artificial Sequence: Synthetic oligonucleotide
  Target: FXN; (+) strand; PAM type: YTN; PAM sequence: CTG
agtagctgagatcacaggca

SEQ ID NO: 30414 - DNA, 20 bp, Artificial Sequence
  Description of Artificial Sequence: Synthetic oligonucleotide
  Target: FXN; (+) strand; PAM type: YTN; PAM sequence: CTG
agatcacaggcatgcactac

SEQ ID NO: 30415 - DNA, 20 bp, Artificial Sequence
  Description of Artificial Sequence: Synthetic oligonucleotide
  Target: FXN; (+) strand; PAM type: YTN; PAM sequence: CTA
ccacactcggctcacatttg

SEQ ID NO: 30416 - DNA, 20 bp, Artificial Sequence
  Description of Artificial Sequence: Synthetic oligonucleotide
  Target: FXN; (+) strand; PAM type: YTN; PAM sequence: CTC
ggctcacatttgacatcctc

SEQ ID NO: 30417 - DNA, 20 bp, Artificial Sequence
  Description of Artificial Sequence: Synthetic oligonucleotide
  Target: FXN; (+) strand; PAM type: YTN; PAM sequence: CTC
acatttgacatcctctaaag

SEQ ID NO: 30418 - DNA, 20 bp, Artificial Sequence
  Description of Artificial Sequence: Synthetic oligonucleotide
  Target: FXN; (+) strand; PAM type: YTN; PAM sequence: TTT
gacatcctctaaagcatata

SEQ ID NO: 30419 - DNA, 20 bp, Artificial Sequence
  Description of Artificial Sequence: Synthetic oligonucleotide
  Target: FXN; (+) strand; PAM type: YTN; PAM sequence: TTG
acatcctctaaagcatatat

SEQ ID NO: 30420 - DNA, 20 bp, Artificial Sequence
  Description of Artificial Sequence: Synthetic oligonucleotide
  Target: FXN; (+) strand; PAM type: YTN; PAM sequence: CTC
taaagcatatataaaatgtg

SEQ ID NO: 30421 - DNA, 20 bp, Artificial Sequence
  Description of Artificial Sequence: Synthetic oligonucleotide
  Target: FXN; (+) strand; PAM type: YTN; PAM sequence: CTA
aagcatatataaaatgtgaa

SEQ ID NO: 30422 - DNA, 20 bp, Artificial Sequence
  Description of Artificial Sequence: Synthetic oligonucleotide
  Target: FXN; (+) strand; PAM type: YTN; PAM sequence: CTT
tcacaatttgcatccctttg

SEQ ID NO: 30423 - DNA, 20 bp, Artificial Sequence
  Description of Artificial Sequence: Synthetic oligonucleotide
  Target: FXN; (+) strand; PAM type: YTN; PAM sequence: TTT
cacaatttgcatccctttgt

SEQ ID NO: 30424 - DNA, 20 bp, Artificial Sequence
  Description of Artificial Sequence: Synthetic oligonucleotide
  Target: FXN; (+) strand; PAM type: YTN; PAM sequence: TTC
acaatttgcatccctttgta

SEQ ID NO: 30425 - DNA, 20 bp, Artificial Sequence
  Description of Artificial Sequence: Synthetic oligonucleotide
  Target: FXN; (+) strand; PAM type: YTN; PAM sequence: TTT
gcatccctttgtaatatgta

SEQ ID NO: 30426 - DNA, 20 bp, Artificial Sequence
  Description of Artificial Sequence: Synthetic oligonucleotide
  Target: FXN; (+) strand; PAM type: YTN; PAM sequence: TTG
catccctttgtaatatgtaa

SEQ ID NO: 30427 - DNA, 20 bp, Artificial Sequence
  Description of Artificial Sequence: Synthetic oligonucleotide
  Target: FXN; (+) strand; PAM type: YTN; PAM sequence: CTT
tgtaatatgtaacagaaata

SEQ ID NO: 30428 - DNA, 20 bp, Artificial Sequence
  Description of Artificial Sequence: Synthetic oligonucleotide
  Target: FXN; (+) strand; PAM type: YTN; PAM sequence: TTT
gtaatatgtaacagaaataa

SEQ ID NO: 30429 - DNA, 20 bp, Artificial Sequence
  Description of Artificial Sequence: Synthetic oligonucleotide
  Target: FXN; (+) strand; PAM type: YTN; PAM sequence: TTG
taatatgtaacagaaataaa

SEQ ID NO: 30430 - DNA, 20 bp, Artificial Sequence
  Description of Artificial Sequence: Synthetic oligonucleotide
  Target: FXN; (+) strand; PAM type: YTN; PAM sequence: TTC
tcttttaaaatctatcaaca

SEQ ID NO: 30431 - DNA, 20 bp, Artificial Sequence
  Description of Artificial Sequence: Synthetic oligonucleotide
  Target: FXN; (+) strand; PAM type: YTN; PAM sequence: CTC
ttttaaaatctatcaacaat

SEQ ID NO: 30432 - DNA, 20 bp, Artificial Sequence
  Description of Artificial Sequence: Synthetic oligonucleotide
  Target: FXN; (+) strand; PAM type: YTN; PAM sequence: CTT
ttaaaatctatcaacaatag

SEQ ID NO: 30433 - DNA, 20 bp, Artificial Sequence
  Description of Artificial Sequence: Synthetic oligonucleotide
  Target: FXN; (+) strand; PAM type: YTN; PAM sequence: TTT
taaaatctatcaacaatagg

SEQ ID NO: 30434 - DNA, 20 bp, Artificial Sequence
  Description of Artificial Sequence: Synthetic oligonucleotide
  Target: FXN; (+) strand; PAM type: YTN; PAM sequence: TTT
aaaatctatcaacaataggc

SEQ ID NO: 30435 - DNA, 20 bp, Artificial Sequence
  Description of Artificial Sequence: Synthetic oligonucleotide
  Target: FXN; (+) strand; PAM type: YTN; PAM sequence: TTA
aaatctatcaacaataggca

SEQ ID NO: 30436 - DNA, 20 bp, Artificial Sequence
  Description of Artificial Sequence: Synthetic oligonucleotide
  Target: FXN; (+) strand; PAM type: YTN; PAM sequence: CTA
tcaacaataggcaaggcacg

SEQ ID NO: 30437 - DNA, 20 bp, Artificial Sequence
  Description of Artificial Sequence: Synthetic oligonucleotide
  Target: FXN; (+) strand; PAM type: YTN; PAM sequence: CTC
acgcctgtcgtctcagcact

SEQ ID NO: 30438 - DNA, 20 bp, Artificial Sequence
  Description of Artificial Sequence: Synthetic oligonucleotide
  Target: FXN; (+) strand; PAM type: YTN; PAM sequence: CTG
tcgtctcagcactttgtgag

SEQ ID NO: 30439 - DNA, 20 bp, Artificial Sequence
  Description of Artificial Sequence: Synthetic oligonucleotide
  Target: FXN; (+) strand; PAM type: YTN; PAM sequence: CTC
agcactttgtgaggcccagg

SEQ ID NO: 30440 - DNA, 20 bp, Artificial Sequence
  Description of Artificial Sequence: Synthetic oligonucleotide
  Target: FXN; (+) strand; PAM type: YTN; PAM sequence: CTT
tgtgaggcccaggcgggcag

SEQ ID NO: 30441 - DNA, 20 bp, Artificial Sequence
  Description of Artificial Sequence: Synthetic oligonucleotide
  Target: FXN; (+) strand; PAM type: YTN; PAM sequence: TTT
gtgaggcccaggcgggcaga

SEQ ID NO: 30442 - DNA, 20 bp, Artificial Sequence
  Description of Artificial Sequence: Synthetic oligonucleotide
  Target: FXN; (+) strand; PAM type: YTN; PAM sequence: TTG
tgaggcccaggcgggcagat

SEQ ID NO: 30443 - DNA, 20 bp, Artificial Sequence
  Description of Artificial Sequence: Synthetic oligonucleotide
  Target: FXN; (+) strand; PAM type: YTN; PAM sequence: TTT
gagcctagaagttcaagacc

SEQ ID NO: 30444 - DNA, 20 bp, Artificial Sequence
  Description of Artificial Sequence: Synthetic oligonucleotide
  Target: FXN; (+) strand; PAM type: YTN; PAM sequence: TTG
agcctagaagttcaagacca

SEQ ID NO: 30445 - DNA, 20 bp, Artificial Sequence
  Description of Artificial Sequence: Synthetic oligonucleotide
  Target: FXN; (+) strand; PAM type: YTN; PAM sequence: CTA
gaagttcaagaccaccctgg

SEQ ID NO: 30446 - DNA, 20 bp, Artificial Sequence
  Description of Artificial Sequence: Synthetic oligonucleotide
  Target: FXN; (+) strand; PAM type: YTN; PAM sequence: TTC
aagaccaccctgggcaacat

SEQ ID NO: 30447 - DNA, 20 bp, Artificial Sequence
  Description of Artificial Sequence: Synthetic oligonucleotide
  Target: FXN; (+) strand; PAM type: YTN; PAM sequence: CTG
ggcaacatagcgaaaccccc

SEQ ID NO: 30448 - DNA, 20 bp, Artificial Sequence
  Description of Artificial Sequence: Synthetic oligonucleotide
  Target: FXN; (+) strand; PAM type: YTN; PAM sequence: CTT
tctacaaaaaatacaaaaac

SEQ ID NO: 30449 - DNA, 20 bp, Artificial Sequence
  Description of Artificial Sequence: Synthetic oligonucleotide
  Target: FXN; (+) strand; PAM type: YTN; PAM sequence: TTT
ctacaaaaaatacaaaaact

SEQ ID NO: 30450 - DNA, 20 bp, Artificial Sequence
  Description of Artificial Sequence: Synthetic oligonucleotide
  Target: FXN; (+) strand; PAM type: YTN; PAM sequence: TTC
tacaaaaaatacaaaaacta

SEQ ID NO: 30451 - DNA, 20 bp, Artificial Sequence
  Description of Artificial Sequence: Synthetic oligonucleotide
  Target: FXN; (+) strand; PAM type: YTN; PAM sequence: CTA
caaaaaatacaaaaactagc

SEQ ID NO: 30452 - DNA, 20 bp, Artificial Sequence
  Description of Artificial Sequence: Synthetic oligonucleotide
  Target: FXN; (+) strand; PAM type: YTN; PAM sequence: CTA
gctgggtgtggtggtgcaca

SEQ ID NO: 30453 - DNA, 20 bp, Artificial Sequence
  Description of Artificial Sequence: Synthetic oligonucleotide
  Target: FXN; (+) strand; PAM type: YTN; PAM sequence: CTG
ggtgtggtggtgcacacctg

SEQ ID NO: 30454 - DNA, 20 bp, Artificial Sequence
  Description of Artificial Sequence: Synthetic oligonucleotide
  Target: FXN; (+) strand; PAM type: YTN; PAM sequence: CTG
tagtcccagctacttggaag

SEQ ID NO: 30455 - DNA, 20 bp, Artificial Sequence
  Description of Artificial Sequence: Synthetic oligonucleotide
  Target: FXN; (+) strand; PAM type: YTN; PAM sequence: CTA
cttggaaggctgaaatggga

SEQ ID NO: 30456 - DNA, 20 bp, Artificial Sequence
  Description of Artificial Sequence: Synthetic oligonucleotide
  Target: FXN; (+) strand; PAM type: YTN; PAM sequence: CTT
ggaaggctgaaatgggaaga

SEQ ID NO: 30457 - DNA, 20 bp, Artificial Sequence
  Description of Artificial Sequence: Synthetic oligonucleotide
  Target: FXN; (+) strand; PAM type: YTN; PAM sequence: TTG
gaaggctgaaatgggaagac

SEQ ID NO: 30458 - DNA, 20 bp, Artificial Sequence
  Description of Artificial Sequence: Synthetic oligonucleotide
  Target: FXN; (+) strand; PAM type: YTN; PAM sequence: CTG
aaatgggaagactgcttgag

SEQ ID NO: 30459 - DNA, 20 bp, Artificial Sequence
  Description of Artificial Sequence: Synthetic oligonucleotide
  Target: FXN; (+) strand; PAM type: YTN; PAM sequence: CTG
cttgagcccgggagggagaa

SEQ ID NO: 30460 - DNA, 20 bp, Artificial Sequence
  Description of Artificial Sequence: Synthetic oligonucleotide
  Target: FXN; (+) strand; PAM type: YTN; PAM sequence: CTT
gagcccgggagggagaagtt

SEQ ID NO: 30461 - DNA, 20 bp, Artificial Sequence
  Description of Artificial Sequence: Synthetic oligonucleotide
  Target: FXN; (+) strand; PAM type: YTN; PAM sequence: TTG
agcccgggagggagaagttg

SEQ ID NO: 30462 - DNA, 20 bp, Artificial Sequence
  Description of Artificial Sequence: Synthetic oligonucleotide
  Target: FXN; (+) strand; PAM type: YTN; PAM sequence: TTG
cagtaagccaggaccacacc

SEQ ID NO: 30463 - DNA, 20 bp, Artificial Sequence
  Description of Artificial Sequence: Synthetic oligonucleotide
  Target: FXN; (+) strand; PAM type: YTN; PAM sequence: CTG
cactccagcctgggcaacag

SEQ ID NO: 30464 - DNA, 20 bp, Artificial Sequence
  Description of Artificial Sequence: Synthetic oligonucleotide
  Target: FXN; (+) strand; PAM type: YTN; PAM sequence: CTC
cagcctgggcaacagagtga

SEQ ID NO: 30465 - DNA, 20 bp, Artificial Sequence
  Description of Artificial Sequence: Synthetic oligonucleotide
  Target: FXN; (+) strand; PAM type: YTN; PAM sequence: CTG
ggcaacagagtgagactctg

SEQ ID NO: 30466 - DNA, 20 bp, Artificial Sequence
  Description of Artificial Sequence: Synthetic oligonucleotide
  Target: FXN; (+) strand; PAM type: YTN; PAM sequence: CTC
tgtctcaaacaaacaaataa

SEQ ID NO: 30467 - DNA, 20 bp, Artificial Sequence
  Description of Artificial Sequence: Synthetic oligonucleotide
  Target: FXN; (+) strand; PAM type: YTN; PAM sequence: CTG
tctcaaacaaacaaataaat

SEQ ID NO: 30468 - DNA, 20 bp, Artificial Sequence
  Description of Artificial Sequence: Synthetic oligonucleotide
  Target: FXN; (+) strand; PAM type: YTN; PAM sequence: CTC
aaacaaacaaataaatgagg

SEQ ID NO: 30469 - DNA, 20 bp, Artificial Sequence
  Description of Artificial Sequence: Synthetic oligonucleotide
  Target: FXN; (+) strand; PAM type: YTN; PAM sequence: CTG
gctaacacggtgaaacccgt

SEQ ID NO: 30470 - DNA, 20 bp, Artificial Sequence
  Description of Artificial Sequence: Synthetic oligonucleotide
  Target: FXN; (+) strand; PAM type: YTN; PAM sequence: CTA
acacggtgaaacccgtctct

SEQ ID NO: 30471 - DNA, 20 bp, Artificial Sequence
  Description of Artificial Sequence: Synthetic oligonucleotide
  Target: FXN; (+) strand; PAM type: YTN; PAM sequence: CTC
tactaaaaaaaaaaaaaaat

SEQ ID NO: 30472 - DNA, 20 bp, Artificial Sequence
  Description of Artificial Sequence: Synthetic oligonucleotide
  Target: FXN; (+) strand; PAM type: YTN; PAM sequence: CTA
ctaaaaaaaaaaaaaaatac

SEQ ID NO: 30473 - DNA, 20 bp, Artificial Sequence
  Description of Artificial Sequence: Synthetic oligonucleotide
  Target: FXN; (+) strand; PAM type: YTN; PAM sequence: CTA
aaaaaaaaaaaaaatacaaa

SEQ ID NO: 30474 - DNA, 20 bp, Artificial Sequence
  Description of Artificial Sequence: Synthetic oligonucleotide
  Target: FXN; (+) strand; PAM type: YTN; PAM sequence: TTA
gccaggcatggtggcgggcg

SEQ ID NO: 30475 - DNA, 20 bp, Artificial Sequence
  Description of Artificial Sequence: Synthetic oligonucleotide
  Target: FXN; (+) strand; PAM type: YTN; PAM sequence: CTG
tagtcccagttactcgggag

SEQ ID NO: 30476 - DNA, 20 bp, Artificial Sequence
  Description of Artificial Sequence: Synthetic oligonucleotide
  Target: FXN; (+) strand; PAM type: YTN; PAM sequence: TTA
ctcgggaggctgaggcagga

SEQ ID NO: 30477 - DNA, 20 bp, Artificial Sequence
  Description of Artificial Sequence: Synthetic oligonucleotide
  Target: FXN; (+) strand; PAM type: YTN; PAM sequence: CTC
gggaggctgaggcaggagaa

SEQ ID NO: 30478 - DNA, 20 bp, Artificial Sequence
  Description of Artificial Sequence: Synthetic oligonucleotide
  Target: FXN; (+) strand; PAM type: YTN; PAM sequence: CTG
aggcaggagaatggcgtgaa

SEQ ID NO: 30479 - DNA, 20 bp, Artificial Sequence
  Description of Artificial Sequence: Synthetic oligonucleotide
  Target: FXN; (+) strand; PAM type: YTN; PAM sequence: CTT
gcagtgagccgagatcgcac

SEQ ID NO: 30480 - DNA, 20 bp, Artificial Sequence
  Description of Artificial Sequence: Synthetic oligonucleotide
  Target: FXN; (+) strand; PAM type: YTN; PAM sequence: TTG
cagtgagccgagatcgcacc

SEQ ID NO: 30481 - DNA, 20 bp, Artificial Sequence
  Description of Artificial Sequence: Synthetic oligonucleotide
  Target: FXN; (+) strand; PAM type: YTN; PAM sequence: CTG
ccctccagcctgggcgacag

SEQ ID NO: 30482 - DNA, 20 bp, Artificial Sequence
  Description of Artificial Sequence: Synthetic oligonucleotide
  Target: FXN; (+) strand; PAM type: YTN; PAM sequence: CTC
cagcctgggcgacagagcga

SEQ ID NO: 30483 - DNA, 20 bp, Artificial Sequence
  Description of Artificial Sequence: Synthetic oligonucleotide
  Target: FXN; (+) strand; PAM type: YTN; PAM sequence: CTG
ggcgacagagcgagactccg

SEQ ID NO: 30484 - DNA, 20 bp, Artificial Sequence
  Description of Artificial Sequence: Synthetic oligonucleotide
  Target: FXN; (+) strand; PAM type: YTN; PAM sequence: CTC
cgtctcaatcaatcaatcaa

SEQ ID NO: 30485 - DNA, 20 bp, Artificial Sequence
  Description of Artificial Sequence: Synthetic oligonucleotide
  Target: FXN; (+) strand; PAM type: YTN; PAM sequence: CTC
aatcaatcaatcaatcaata

SEQ ID NO: 30486 - DNA, 20 bp, Artificial Sequence
  Description of Artificial Sequence: Synthetic oligonucleotide
  Target: FXN; (+) strand; PAM type: YTN; PAM sequence: CTA
ttaacaatatttattgtgca

SEQ ID NO: 30487 - DNA, 20 bp, Artificial Sequence
  Description of Artificial Sequence: Synthetic oligonucleotide
  Target: FXN; (+) strand; PAM type: YTN; PAM sequence: TTA
acaatatttattgtgcactt

SEQ ID NO: 30488 - DNA, 20 bp, Artificial Sequence
  Description of Artificial Sequence: Synthetic oligonucleotide
  Target: FXN; (+) strand; PAM type: YTN; PAM sequence: TTT
attgtgcacttaacaggaac

SEQ ID NO: 30489 - DNA, 20 bp, Artificial Sequence
  Description of Artificial Sequence: Synthetic oligonucleotide
  Target: FXN; (+) strand; PAM type: YTN; PAM sequence: TTA
ttgtgcacttaacaggaaca

SEQ ID NO: 30490 - DNA, 20 bp, Artificial Sequence
  Description of Artificial Sequence: Synthetic oligonucleotide
  Target: FXN; (+) strand; PAM type: YTN; PAM sequence: TTG
tgcacttaacaggaacatgc

SEQ ID NO: 30491 - DNA, 20 bp, Artificial Sequence
  Description of Artificial Sequence: Synthetic oligonucleotide
  Target: FXN; (+) strand; PAM type: YTN; PAM sequence: CTT
aacaggaacatgccctgtcc

SEQ ID NO: 30492 - DNA, 20 bp, Artificial Sequence
  Description of Artificial Sequence: Synthetic oligonucleotide
  Target: FXN; (+) strand; PAM type: YTN; PAM sequence: TTA
acaggaacatgccctgtcca

SEQ ID NO: 30493 - DNA, 20 bp, Artificial Sequence
  Description of Artificial Sequence: Synthetic oligonucleotide
  Target: FXN; (+) strand; PAM type: YTN; PAM sequence: CTG
tccaaaaaaaactttacagg

SEQ ID NO: 30494 - DNA, 20 bp, Artificial Sequence
  Description of Artificial Sequence: Synthetic oligonucleotide
  Target: FXN; (+) strand; PAM type: YTN; PAM sequence: CTT
tacagggcttaactcatttt

SEQ ID NO: 30495 - DNA, 20 bp, Artificial Sequence
  Description of Artificial Sequence: Synthetic oligonucleotide
  Target: FXN; (+) strand; PAM type: YTN; PAM sequence: TTT
acagggcttaactcatttta

SEQ ID NO: 30496 - DNA, 20 bp, Artificial Sequence
  Description of Artificial Sequence: Synthetic oligonucleotide
  Target: FXN; (+) strand; PAM type: YTN; PAM sequence: TTA
cagggcttaactcattttat

SEQ ID NO: 30497 - DNA, 20 bp, Artificial Sequence
  Description of Artificial Sequence: Synthetic oligonucleotide
  Target: FXN; (+) strand; PAM type: YTN; PAM sequence: CTT
aactcattttatccttacca

SEQ ID NO: 30498 - DNA, 20 bp, Artificial Sequence
  Description of Artificial Sequence: Synthetic oligonucleotide
  Target: FXN; (+) strand; PAM type: YTN; PAM sequence: TTA
actcattttatccttaccac

SEQ ID NO: 30499 - DNA, 20 bp, Artificial Sequence
  Description of Artificial Sequence: Synthetic oligonucleotide
  Target: FXN; (+) strand; PAM type: YTN; PAM sequence: CTC
attttatccttaccacaatc

SEQ ID NO: 30500 - DNA, 20 bp, Artificial Sequence
  Description of Artificial Sequence: Synthetic oligonucleotide
  Target: FXN; (+) strand; PAM type: YTN; PAM sequence: TTT
tatccttaccacaatcctat

SEQ ID NO: 30501 - DNA, 20 bp, Artificial Sequence
  Description of Artificial Sequence: Synthetic oligonucleotide
  Target: FXN; (+) strand; PAM type: YTN; PAM sequence: TTT
atccttaccacaatcctatg

SEQ ID NO: 30502 - DNA, 20 bp, Artificial Sequence
  Description of Artificial Sequence: Synthetic oligonucleotide
  Target: FXN; (+) strand; PAM type: YTN; PAM sequence: TTA
tccttaccacaatcctatga

SEQ ID NO: 30503 - DNA, 20 bp, Artificial Sequence
  Description of Artificial Sequence: Synthetic oligonucleotide
  Target: FXN; (+) strand; PAM type: YTN; PAM sequence: CTT
accacaatcctatgaagtag

SEQ ID NO: 30504 - DNA, 20 bp, Artificial Sequence
  Description of Artificial Sequence: Synthetic oligonucleotide
  Target: FXN; (+) strand; PAM type: YTN; PAM sequence: TTA
ccacaatcctatgaagtagg

SEQ ID NO: 30505 - DNA, 20 bp, Artificial Sequence
  Description of Artificial Sequence: Synthetic oligonucleotide
  Target: FXN; (+) strand; PAM type: YTN; PAM sequence: CTA
tgaagtaggaacttttataa

SEQ ID NO: 30506 - DNA, 20 bp, Artificial Sequence
  Description of Artificial Sequence: Synthetic oligonucleotide
  Target: FXN; (+) strand; PAM type: YTN; PAM sequence: CTT
ttataaaacgcattttataa

SEQ ID NO: 30507 - DNA, 20 bp, Artificial Sequence
  Description of Artificial Sequence: Synthetic oligonucleotide
  Target: FXN; (+) strand; PAM type: YTN; PAM sequence: TTT
tataaaacgcattttataaa

SEQ ID NO: 30508 - DNA, 20 bp, Artificial Sequence
  Description of Artificial Sequence: Synthetic oligonucleotide
  Target: FXN; (+) strand; PAM type: YTN; PAM sequence: TTT
ataaaacgcattttataaac

SEQ ID NO: 30509 - DNA, 20 bp, Artificial Sequence
  Description of Artificial Sequence: Synthetic oligonucleotide
  Target: FXN; (+) strand; PAM type: YTN; PAM sequence: TTA
taaaacgcattttataaaca

SEQ ID NO: 30510 - DNA, 20 bp, Artificial Sequence
  Description of Artificial Sequence: Synthetic oligonucleotide
  Target: FXN; (+) strand; PAM type: YTN; PAM sequence: TTT
tataaacaaggcacagagag

SEQ ID NO: 30511 - DNA, 20 bp, Artificial Sequence
  Description of Artificial Sequence: Synthetic oligonucleotide
  Target: FXN; (+) strand; PAM type: YTN; PAM sequence: TTT
ataaacaaggcacagagagg

SEQ ID NO: 30512 - DNA, 20 bp, Artificial Sequence
  Description of Artificial Sequence: Synthetic oligonucleotide
  Target: FXN; (+) strand; PAM type: YTN; PAM sequence: TTA
taaacaaggcacagagaggt

SEQ ID NO: 30513 - DNA, 20 bp, Artificial Sequence
  Description of Artificial Sequence: Synthetic oligonucleotide
  Target: FXN; (+) strand; PAM type: YTN; PAM sequence: TTA
attaacttgccctctggtca

SEQ ID NO: 30514 - DNA, 20 bp, Artificial Sequence
  Description of Artificial Sequence: Synthetic oligonucleotide
  Target: FXN; (+) strand; PAM type: YTN; PAM sequence: TTA
acttgccctctggtcacaca

SEQ ID NO: 30515 - DNA, 20 bp, Artificial Sequence
  Description of Artificial Sequence: Synthetic oligonucleotide
  Target: FXN; (+) strand; PAM type: YTN; PAM sequence: CTT
gccctctggtcacacagcta

SEQ ID NO: 30516 - DNA, 20 bp, Artificial Sequence
  Description of Artificial Sequence: Synthetic oligonucleotide
  Target: FXN; (+) strand; PAM type: YTN; PAM sequence: TTG
ccctctggtcacacagctag

SEQ ID NO: 30517 - DNA, 20 bp, Artificial Sequence
  Description of Artificial Sequence: Synthetic oligonucleotide
  Target: FXN; (+) strand; PAM type: YTN; PAM sequence: CTC
tggtcacacagctaggaagt

SEQ ID NO: 30518 - DNA, 20 bp, Artificial Sequence
  Description of Artificial Sequence: Synthetic oligonucleotide
  Target: FXN; (+) strand; PAM type: YTN; PAM sequence: CTG
gtcacacagctaggaagtgg

SEQ ID NO: 30519 - DNA, 20 bp, Artificial Sequence
  Description of Artificial Sequence: Synthetic oligonucleotide
  Target: FXN; (+) strand; PAM type: YTN; PAM sequence: CTA
ggaagtgggcagagtacaga

SEQ ID NO: 30520 - DNA, 20 bp, Artificial Sequence
  Description of Artificial Sequence: Synthetic oligonucleotide
  Target: FXN; (+) strand; PAM type: YTN; PAM sequence: TTT
acacaaggcatccgtctcct

SEQ ID NO: 30521 - DNA, 20 bp, Artificial Sequence
  Description of Artificial Sequence: Synthetic oligonucleotide
  Target: FXN; (+) strand; PAM type: YTN; PAM sequence: TTA
cacaaggcatccgtctcctg

SEQ ID NO: 30522 - DNA, 20 bp, Artificial Sequence
  Description of Artificial Sequence: Synthetic oligonucleotide
  Target: FXN; (+) strand; PAM type: YTN; PAM sequence: CTC
ctggccccacatacccaact

SEQ ID NO: 30523 - DNA, 20 bp, Artificial Sequence
  Description of Artificial Sequence: Synthetic oligonucleotide
  Target: FXN; (+) strand; PAM type: YTN; PAM sequence: CTG
gccccacatacccaactgct

SEQ ID NO: 30524 - DNA, 20 bp, Artificial Sequence
  Description of Artificial Sequence: Synthetic oligonucleotide
  Target: FXN; (+) strand; PAM type: YTN; PAM sequence: CTG
ctgtaaacccataccggcgg

SEQ ID NO: 30525 - DNA, 20 bp, Artificial Sequence
  Description of Artificial Sequence: Synthetic oligonucleotide
  Target: FXN; (+) strand; PAM type: YTN; PAM sequence: CTG
taaacccataccggcggcca

SEQ ID NO: 30526 - DNA, 20 bp, Artificial Sequence
  Description of Artificial Sequence: Synthetic oligonucleotide
  Target: FXN; (+) strand; PAM type: YTN; PAM sequence: CTC
aatttgtgcatgcacccact

SEQ ID NO: 30527 - DNA, 20 bp, Artificial Sequence
  Description of Artificial Sequence: Synthetic oligonucleotide
  Target: FXN; (+) strand; PAM type: YTN; PAM sequence: TTT
gtgcatgcacccacttccca

SEQ ID NO: 30528 - DNA, 20 bp, Artificial Sequence
  Description of Artificial Sequence: Synthetic oligonucleotide
  Target: FXN; (+) strand; PAM type: YTN; PAM sequence: TTG
tgcatgcacccacttcccag

SEQ ID NO: 30529 - DNA, 20 bp, Artificial Sequence
  Description of Artificial Sequence: Synthetic oligonucleotide
  Target: FXN; (+) strand; PAM type: YTN; PAM sequence: CTT
cccagcaagacagcagctcc

SEQ ID NO: 30530 - DNA, 20 bp, Artificial Sequence
  Description of Artificial Sequence: Synthetic oligonucleotide
  Target: FXN; (+) strand; PAM type: YTN; PAM sequence: TTC
ccagcaagacagcagctccc

SEQ ID NO: 30531 - DNA, 20 bp, Artificial Sequence
  Description of Artificial Sequence: Synthetic oligonucleotide
  Target: FXN; (+) strand; PAM type: YTN; PAM sequence: CTC
ccaagttcctcctgtttaga

SEQ ID NO: 30532 - DNA, 20 bp, Artificial Sequence
  Description of Artificial Sequence: Synthetic oligonucleotide
  Target: FXN; (+) strand; PAM type: YTN; PAM sequence: TTC
ctcctgtttagaattttaga

SEQ ID NO: 30533 - DNA, 20 bp, Artificial Sequence
  Description of Artificial Sequence: Synthetic oligonucleotide
  Target: FXN; (+) strand; PAM type: YTN; PAM sequence: CTC
ctgtttagaattttagaagc

SEQ ID NO: 30534 - DNA, 20 bp, Artificial Sequence
  Description of Artificial Sequence: Synthetic oligonucleotide
  Target: FXN; (+) strand; PAM type: YTN; PAM sequence: CTG
tttagaattttagaagcggc

SEQ ID NO: 30535 - DNA, 20 bp, Artificial Sequence
  Description of Artificial Sequence: Synthetic oligonucleotide
  Target: FXN; (+) strand; PAM type: YTN; PAM sequence: TTT
agaattttagaagcggcggg

SEQ ID NO: 30536 - DNA, 20 bp, Artificial Sequence
  Description of Artificial Sequence: Synthetic oligonucleotide
  Target: FXN; (+) strand; PAM type: YTN; PAM sequence: TTA
gaattttagaagcggcgggc

SEQ ID NO: 30537 - DNA, 20 bp, Artificial Sequence
  Description of Artificial Sequence: Synthetic oligonucleotide
  Target: FXN; (+) strand; PAM type: YTN; PAM sequence: TTT
tagaagcggcgggccaccag

SEQ ID NO: 30538 - DNA, 20 bp, Artificial Sequence
  Description of Artificial Sequence: Synthetic oligonucleotide
  Target: FXN; (+) strand; PAM type: YTN; PAM sequence: TTT
agaagcggcgggccaccagg

SEQ ID NO: 30539 - DNA, 20 bp, Artificial Sequence
  Description of Artificial Sequence: Synthetic oligonucleotide
  Target: FXN; (+) strand; PAM type: YTN; PAM sequence: TTA
gaagcggcgggccaccaggc

SEQ ID NO: 30540 - DNA, 20 bp, Artificial Sequence
  Description of Artificial Sequence: Synthetic oligonucleotide
  Target: FXN; (+) strand; PAM type: YTN; PAM sequence: CTG
cagtctcccttgggtcaggg

SEQ ID NO: 30541 - DNA, 20 bp, Artificial Sequence
  Description of Artificial Sequence: Synthetic oligonucleotide
  Target: FXN; (+) strand; PAM type: YTN; PAM sequence: CTC
ccttgggtcaggggtcctgg

SEQ ID NO: 30542 - DNA, 20 bp, Artificial Sequence
  Description of Artificial Sequence: Synthetic oligonucleotide
  Target: FXN; (+) strand; PAM type: YTN; PAM sequence: CTT
gggtcaggggtcctggttgc

SEQ ID NO: 30543 - DNA, 20 bp, Artificial Sequence
  Description of Artificial Sequence: Synthetic oligonucleotide
  Target: FXN; (+) strand; PAM type: YTN; PAM sequence: TTG
ggtcaggggtcctggttgca

SEQ ID NO: 30544 - DNA, 20 bp, Artificial Sequence
  Description of Artificial Sequence: Synthetic oligonucleotide
  Target: FXN; (+) strand; PAM type: YTN; PAM sequence: CTG
gttgcactccgtgctttgca

SEQ ID NO: 30545 - DNA, 20 bp, Artificial Sequence
  Description of Artificial Sequence: Synthetic oligonucleotide
  Target: FXN; (+) strand; PAM type: YTN; PAM sequence: TTG
cactccgtgctttgcacaaa

SEQ ID NO: 30546 - DNA, 20 bp, Artificial Sequence
  Description of Artificial Sequence: Synthetic oligonucleotide
  Target: FXN; (+) strand; PAM type: YTN; PAM sequence: CTC
cgtgctttgcacaaagcagg

SEQ ID NO: 30547 - DNA, 20 bp, Artificial Sequence
  Description of Artificial Sequence: Synthetic oligonucleotide
  Target: FXN; (+) strand; PAM type: YTN; PAM sequence: CTT
tgcacaaagcaggctctcca

SEQ ID NO: 30548 - DNA, 20 bp, Artificial Sequence
  Description of Artificial Sequence: Synthetic oligonucleotide
  Target: FXN; (+) strand; PAM type: YTN; PAM sequence: TTT
gcacaaagcaggctctccat

SEQ ID NO: 30549 - DNA, 20 bp, Artificial Sequence
  Description of Artificial Sequence: Synthetic oligonucleotide
  Target: FXN; (+) strand; PAM type: YTN; PAM sequence: TTG
cacaaagcaggctctccatt

SEQ ID NO: 30550 - DNA, 20 bp, Artificial Sequence
  Description of Artificial Sequence: Synthetic oligonucleotide
  Target: FXN; (+) strand; PAM type: YTN; PAM sequence: CTC
tccatttttgttaaatgcac

SEQ ID NO: 30551 - DNA, 20 bp, Artificial Sequence
  Description of Artificial Sequence: Synthetic oligonucleotide
  Target: FXN; (+) strand; PAM type: YTN; PAM sequence: CTC
catttttgttaaatgcacga

SEQ ID NO: 30552 - DNA, 20 bp, Artificial Sequence
  Description of Artificial Sequence: Synthetic oligonucleotide
  Target: FXN; (+) strand; PAM type: YTN; PAM sequence: TTT
ttgttaaatgcacgaatagt

SEQ ID NO: 30553 - DNA, 20 bp, Artificial Sequence
  Description of Artificial Sequence: Synthetic oligonucleotide
  Target: FXN; (+) strand; PAM type: YTN; PAM sequence: TTT
tgttaaatgcacgaatagtg

SEQ ID NO: 30554 - DNA, 20 bp, Artificial Sequence
  Description of Artificial Sequence: Synthetic oligonucleotide
  Target: FXN; (+) strand; PAM type: YTN; PAM sequence: TTT
gttaaatgcacgaatagtgc

SEQ ID NO: 30555 - DNA, 20 bp, Artificial Sequence
  Description of Artificial Sequence: Synthetic oligonucleotide
  Target: FXN; (+) strand; PAM type: YTN; PAM sequence: TTG
ttaaatgcacgaatagtgct

SEQ ID NO: 30556 - DNA, 20 bp, Artificial Sequence
  Description of Artificial Sequence: Synthetic oligonucleotide
  Target: FXN; (+) strand; PAM type: YTN; PAM sequence: TTA
aatgcacgaatagtgctaag

SEQ ID NO: 30557 - DNA, 20 bp, Artificial Sequence
  Description of Artificial Sequence: Synthetic oligonucleotide
  Target: FXN; (+) strand; PAM type: YTN; PAM sequence: CTA
agctgggaagttcttcctga

SEQ ID NO: 30558 - DNA, 20 bp, Artificial Sequence
  Description of Artificial Sequence: Synthetic oligonucleotide
  Target: FXN; (+) strand; PAM type: YTN; PAM sequence: CTG
ggaagttcttcctgaggtct

SEQ ID NO: 30559 - DNA, 20 bp, Artificial Sequence
  Description of Artificial Sequence: Synthetic oligonucleotide
  Target: FXN; (+) strand; PAM type: YTN; PAM sequence: TTC
ttcctgaggtctaacctcta

SEQ ID NO: 30560 - DNA, 20 bp, Artificial Sequence
  Description of Artificial Sequence: Synthetic oligonucleotide
  Target: FXN; (+) strand; PAM type: YTN; PAM sequence: CTT
cctgaggtctaacctctagc

SEQ ID NO: 30561 - DNA, 20 bp, Artificial Sequence
  Description of Artificial Sequence: Synthetic oligonucleotide
  Target: FXN; (+) strand; PAM type: YTN; PAM sequence: TTC
ctgaggtctaacctctagct

SEQ ID NO: 30562 - DNA, 20 bp, Artificial Sequence
  Description of Artificial Sequence: Synthetic oligonucleotide
  Target: FXN; (+) strand; PAM type: YTN; PAM sequence: CTG
aggtctaacctctagctgct

SEQ ID NO: 30563 - DNA, 20 bp, Artificial Sequence
  Description of Artificial Sequence: Synthetic oligonucleotide
  Target: FXN; (+) strand; PAM type: YTN; PAM sequence: CTA
acctctagctgctcccccac

SEQ ID NO: 30564 - DNA, 20 bp, Artificial Sequence
  Description of Artificial Sequence: Synthetic oligonucleotide
  Target: FXN; (+) strand; PAM type: YTN; PAM sequence: CTC
tagctgctcccccacagaag

SEQ ID NO: 30565 - DNA, 20 bp, Artificial Sequence
  Description of Artificial Sequence: Synthetic oligonucleotide
  Target: FXN; (+) strand; PAM type: YTN; PAM sequence: CTA
gctgctcccccacagaagag

SEQ ID NO: 30566 - DNA, 20 bp, Artificial Sequence
  Description of Artificial Sequence: Synthetic oligonucleotide
  Target: FXN; (+) strand; PAM type: YTN; PAM sequence: CTG
ctcccccacagaagagtgcc

SEQ ID NO: 30567 - DNA, 20 bp, Artificial Sequence
  Description of Artificial Sequence: Synthetic oligonucleotide
  Target: FXN; (+) strand; PAM type: YTN; PAM sequence: CTC
ccccacagaagagtgcctgc

SEQ ID NO: 30568 - DNA, 20 bp, Artificial Sequence
  Description of Artificial Sequence: Synthetic oligonucleotide
  Target: FXN; (+) strand; PAM type: YTN; PAM sequence: CTG
cggccagtggccaccagggg

SEQ ID NO: 30569 - DNA, 20 bp, Artificial Sequence
  Description of Artificial Sequence: Synthetic oligonucleotide
  Target: FXN; (+) strand; PAM type: YTN; PAM sequence: CTG
gagggcggagcgggcggcag

SEQ ID NO: 30570 - DNA, 20 bp, Artificial Sequence
  Description of Artificial Sequence: Synthetic oligonucleotide
  Target: FXN; (+) strand; PAM type: YTN; PAM sequence: CTC
tcgggcgccgcgcagtagcc

SEQ ID NO: 30571 - DNA, 20 bp, Artificial Sequence
  Description of Artificial Sequence: Synthetic oligonucleotide
  Target: FXN; (+) strand; PAM type: YTN; PAM sequence: CTC
gggcgccgcgcagtagccgg

SEQ ID NO: 30572 - DNA, 20 bp, Artificial Sequence
  Description of Artificial Sequence: Synthetic oligonucleotide
  Target: FXN; (+) strand; PAM type: YTN; PAM sequence: CTC
ctggcgtcacccagcccagc

SEQ ID NO: 30573 - DNA, 20 bp, Artificial Sequence
  Description of Artificial Sequence: Synthetic oligonucleotide
  Target: FXN; (+) strand; PAM type: YTN; PAM sequence: CTG
gcgtcacccagcccagccca

SEQ ID NO: 30574 - DNA, 20 bp, Artificial Sequence
  Description of Artificial Sequence: Synthetic oligonucleotide
  Target: FXN; (+) strand; PAM type: YTN; PAM sequence: CTC
acccgggtcccgcggccggc

SEQ ID NO: 30575 - DNA, 20 bp, Artificial Sequence
  Description of Artificial Sequence: Synthetic oligonucleotide
  Target: FXN; (+) strand; PAM type: YTN; PAM sequence: TTG
gccccactctgcggccgccg

SEQ ID NO: 30576 - DNA, 20 bp, Artificial Sequence
  Description of Artificial Sequence: Synthetic oligonucleotide
  Target: FXN; (+) strand; PAM type: YTN; PAM sequence: CTC
tgcggccgccgtggcctgcg

SEQ ID NO: 30577 - DNA, 20 bp, Artificial Sequence
  Description of Artificial Sequence: Synthetic oligonucleotide
  Target: FXN; (+) strand; PAM type: YTN; PAM sequence: CTG
cggccgccgtggcctgcgca

SEQ ID NO: 30578 - DNA, 20 bp, Artificial Sequence
  Description of Artificial Sequence: Synthetic oligonucleotide
  Target: FXN; (+) strand; PAM type: YTN; PAM sequence: CTG
cgcaccgacatcgatgcgac

SEQ ID NO: 30579 - DNA, 20 bp, Artificial Sequence
  Description of Artificial Sequence: Synthetic oligonucleotide
  Target: FXN; (+) strand; PAM type: YTN; PAM sequence: CTG
cacgccccgccgcgcagtaa

SEQ ID NO: 30580 - DNA, 20 bp, Artificial Sequence
  Description of Artificial Sequence: Synthetic oligonucleotide
  Target: FXN; (+) strand; PAM type: YTN; PAM sequence: CTG
cgcagggaggcgccgcgcac

SEQ ID NO: 30581 - DNA, 20 bp, Artificial Sequence
  Description of Artificial Sequence: Synthetic oligonucleotide
  Target: FXN; (+) strand; PAM type: YTN; PAM sequence: CTC
cgggtacgcgcgctggacta

SEQ ID NO: 30582 - DNA, 20 bp, Artificial Sequence
  Description of Artificial Sequence: Synthetic oligonucleotide
  Target: FXN; (+) strand; PAM type: YTN; PAM sequence: CTG
gactagctcaccccgctcct

SEQ ID NO: 30583 - DNA, 20 bp, Artificial Sequence
  Description of Artificial Sequence: Synthetic oligonucleotide
  Target: FXN; (+) strand; PAM type: YTN; PAM sequence: CTA
gctcaccccgctccttctca

SEQ ID NO: 30584 - DNA, 20 bp, Artificial Sequence
  Description of Artificial Sequence: Synthetic oligonucleotide
  Target: FXN; (+) strand; PAM type: YTN; PAM sequence: CTC
accccgctccttctcagggc

SEQ ID NO: 30585 - DNA, 20 bp, Artificial Sequence
  Description of Artificial Sequence: Synthetic oligonucleotide
  Target: FXN; (+) strand; PAM type: YTN; PAM sequence: CTC
cttctcagggcggcccggcg

SEQ ID NO: 30586 - DNA, 20 bp, Artificial Sequence
  Description of Artificial Sequence: Synthetic oligonucleotide
  Target: FXN; (+) strand; PAM type: YTN; PAM sequence: CTT
ctcagggcggcccggcggaa

SEQ ID NO: 30587 - DNA, 20 bp, Artificial Sequence
  Description of Artificial Sequence: Synthetic oligonucleotide
  Target: FXN; (+) strand; PAM type: YTN; PAM sequence: TTC
tcagggcggcccggcggaag

SEQ ID NO: 30588 - DNA, 20 bp, Artificial Sequence
  Description of Artificial Sequence: Synthetic oligonucleotide
  Target: FXN; (+) strand; PAM type: YTN; PAM sequence: CTC
agggcggcccggcggaagcg

SEQ ID NO: 30589 - DNA, 20 bp, Artificial Sequence
  Description of Artificial Sequence: Synthetic oligonucleotide
  Target: FXN; (+) strand; PAM type: YTN; PAM sequence: CTT
gcaactcccttctctggttc

SEQ ID NO: 30590 - DNA, 20 bp, Artificial Sequence
  Description of Artificial Sequence: Synthetic oligonucleotide
  Target: FXN; (+) strand; PAM type: YTN; PAM sequence: TTG
caactcccttctctggttct

SEQ ID NO: 30591 - DNA, 20 bp, Artificial Sequence
  Description of Artificial Sequence: Synthetic oligonucleotide
  Target: FXN; (+) strand; PAM type: YTN; PAM sequence: CTC
ccttctctggttctcccggt

SEQ ID NO: 30592 - DNA, 20 bp, Artificial Sequence
  Description of Artificial Sequence: Synthetic oligonucleotide
  Target: FXN; (+) strand; PAM type: YTN; PAM sequence: CTT
ctctggttctcccggttgca

SEQ ID NO: 30593 - DNA, 20 bp, Artificial Sequence
  Description of Artificial Sequence: Synthetic oligonucleotide
  Target: FXN; (+) strand; PAM type: YTN; PAM sequence: TTC
tctggttctcccggttgcat

SEQ ID NO: 30594 - DNA, 20 bp, Artificial Sequence
  Description of Artificial Sequence: Synthetic oligonucleotide
  Target: FXN; (+) strand; PAM type: YTN; PAM sequence: CTC
tggttctcccggttgcattt

SEQ ID NO: 30595 - DNA, 20 bp, Artificial Sequence
  Description of Artificial Sequence: Synthetic oligonucleotide
  Target: FXN; (+) strand; PAM type: YTN; PAM sequence: CTG
gttctcccggttgcatttac

SEQ ID NO: 30596 - DNA, 20 bp, Artificial Sequence
  Description of Artificial Sequence: Synthetic oligonucleotide
  Target: FXN; (+) strand; PAM type: YTN; PAM sequence: TTC
tcccggttgcatttacactg

SEQ ID NO: 30597 - DNA, 20 bp, Artificial Sequence
  Description of Artificial Sequence: Synthetic oligonucleotide
  Target: FXN; (+) strand; PAM type: YTN; PAM sequence: CTC
ccggttgcatttacactggc

SEQ ID NO: 30598 - DNA, 20 bp, Artificial Sequence
  Description of Artificial Sequence: Synthetic oligonucleotide
  Target: FXN; (+) strand; PAM type: YTN; PAM sequence: TTG
catttacactggcttctgct

SEQ ID NO: 30599 - DNA, 20 bp, Artificial Sequence
  Description of Artificial Sequence: Synthetic oligonucleotide
  Target: FXN; (+) strand; PAM type: YTN; PAM sequence: TTT
acactggcttctgctttccg

SEQ ID NO: 30600 - DNA, 20 bp, Artificial Sequence
  Description of Artificial Sequence: Synthetic oligonucleotide
  Target: FXN; (+) strand; PAM type: YTN; PAM sequence: TTA
cactggcttctgctttccga

SEQ ID NO: 30601 - DNA, 20 bp, Artificial Sequence
  Description of Artificial Sequence: Synthetic oligonucleotide
  Target: FXN; (+) strand; PAM type: YTN; PAM sequence: CTG
gcttctgctttccgaaggaa

SEQ ID NO: 30602 - DNA, 20 bp, Artificial Sequence
  Description of Artificial Sequence: Synthetic oligonucleotide
  Target: FXN; (+) strand; PAM type: YTN; PAM sequence: CTT
ctgctttccgaaggaaaagg

SEQ ID NO: 30603 - DNA, 20 bp, Artificial Sequence
  Description of Artificial Sequence: Synthetic oligonucleotide
  Target: FXN; (+) strand; PAM type: YTN; PAM sequence: TTC
tgctttccgaaggaaaaggg

SEQ ID NO: 30604 - DNA, 20 bp, Artificial Sequence
  Description of Artificial Sequence: Synthetic oligonucleotide
  Target: FXN; (+) strand; PAM type: YTN; PAM sequence: CTG
ctttccgaaggaaaagggga

SEQ ID NO: 30605 - DNA, 20 bp, Artificial Sequence
  Description of Artificial Sequence: Synthetic oligonucleotide
  Target: FXN; (+) strand; PAM type: YTN; PAM sequence: CTT
tccgaaggaaaaggggacat

SEQ ID NO: 30606 - DNA, 20 bp, Artificial Sequence
  Description of Artificial Sequence: Synthetic oligonucleotide
  Target: FXN; (+) strand; PAM type: YTN; PAM sequence: TTT
ccgaaggaaaaggggacatt

SEQ ID NO: 30607 - DNA, 20 bp, Artificial Sequence
  Description of Artificial Sequence: Synthetic oligonucleotide
  Target: FXN; (+) strand; PAM type: YTN; PAM sequence: TTC
cgaaggaaaaggggacattt

SEQ ID NO: 30608 - DNA, 20 bp, Artificial Sequence
  Description of Artificial Sequence: Synthetic oligonucleotide
  Target: FXN; (+) strand; PAM type: YTN; PAM sequence: TTT
tgtcctgcggtgcgactgcg

SEQ ID NO: 30609 - DNA, 20 bp, Artificial Sequence
  Description of Artificial Sequence: Synthetic oligonucleotide
  Target: FXN; (+) strand; PAM type: YTN; PAM sequence: TTT
gtcctgcggtgcgactgcgg

SEQ ID NO: 30610 - DNA, 20 bp, Artificial Sequence
  Description of Artificial Sequence: Synthetic oligonucleotide
  Target: FXN; (+) strand; PAM type: YTN; PAM sequence: TTG
tcctgcggtgcgactgcggg

SEQ ID NO: 30611 - DNA, 20 bp, Artificial Sequence
  Description of Artificial Sequence: Synthetic oligonucleotide
  Target: FXN; (+) strand; PAM type: YTN; PAM sequence: CTG
cggtgcgactgcgggtcaag

SEQ ID NO: 30612 - DNA, 20 bp, Artificial Sequence
  Description of Artificial Sequence: Synthetic oligonucleotide
  Target: FXN; (+) strand; PAM type: YTN; PAM sequence: CTG
cgggtcaaggcacgggcgaa

SEQ ID NO: 30613 - DNA, 20 bp, Artificial Sequence
  Description of Artificial Sequence: Synthetic oligonucleotide
  Target: FXN; (+) strand; PAM type: YTN; PAM sequence: CTG
gtggaggggaccggttccga

SEQ ID NO: 30614 - DNA, 20 bp, Artificial Sequence
  Description of Artificial Sequence: Synthetic oligonucleotide
  Target: FXN; (+) strand; PAM type: YTN; PAM sequence: TTC
cgaggggtgtgcggctgtct

SEQ ID NO: 30615 - DNA, 20 bp, Artificial Sequence
  Description of Artificial Sequence: Synthetic oligonucleotide
  Target: FXN; (+) strand; PAM type: YTN; PAM sequence: CTG
tctccatgcttgtcacttct

SEQ ID NO: 30616 - DNA, 20 bp, Artificial Sequence
  Description of Artificial Sequence: Synthetic oligonucleotide
  Target: FXN; (+) strand; PAM type: YTN; PAM sequence: CTC
catgcttgtcacttctctgc

SEQ ID NO: 30617 - DNA, 20 bp, Artificial Sequence
  Description of Artificial Sequence: Synthetic oligonucleotide
  Target: FXN; (+) strand; PAM type: YTN; PAM sequence: CTT
gtcacttctctgcgataact

SEQ ID NO: 30618 - DNA, 20 bp, Artificial Sequence
  Description of Artificial Sequence: Synthetic oligonucleotide
  Target: FXN; (+) strand; PAM type: YTN; PAM sequence: TTG
tcacttctctgcgataactt

SEQ ID NO: 30619 - DNA, 20 bp, Artificial Sequence
  Description of Artificial Sequence: Synthetic oligonucleotide
  Target: FXN; (+) strand; PAM type: YTN; PAM sequence: CTT
ctctgcgataacttgtttca

SEQ ID NO: 30620 - DNA, 20 bp, Artificial Sequence
  Description of Artificial Sequence: Synthetic oligonucleotide
  Target: FXN; (+) strand; PAM type: YTN; PAM sequence: TTC
tctgcgataacttgtttcag

SEQ ID NO: 30621 - DNA, 20 bp, Artificial Sequence
  Description of Artificial Sequence: Synthetic oligonucleotide
  Target: FXN; (+) strand; PAM type: YTN; PAM sequence: CTC
tgcgataacttgtttcagta

SEQ ID NO: 30622 - DNA, 20 bp, Artificial Sequence
  Description of Artificial Sequence: Synthetic oligonucleotide
  Target: FXN; (+) strand; PAM type: YTN; PAM sequence: CTG
cgataacttgtttcagtaat

SEQ ID NO: 30623 - DNA, 20 bp, Artificial Sequence
  Description of Artificial Sequence: Synthetic oligonucleotide
  Target: FXN; (+) strand; PAM type: YTN; PAM sequence: CTT
gtttcagtaatattaataga

SEQ ID NO: 30624 - DNA, 20 bp, Artificial Sequence
  Description of Artificial Sequence: Synthetic oligonucleotide
  Target: FXN; (+) strand; PAM type: YTN; PAM sequence: TTG
tttcagtaatattaatagat

SEQ ID NO: 30625 - DNA, 20 bp, Artificial Sequence
  Description of Artificial Sequence: Synthetic oligonucleotide
  Target: FXN; (+) strand; PAM type: YTN; PAM sequence: TTT
cagtaatattaatagatggt

SEQ ID NO: 30626 - DNA, 20 bp, Artificial Sequence
  Description of Artificial Sequence: Synthetic oligonucleotide
  Target: FXN; (+) strand; PAM type: YTN; PAM sequence: TTC
agtaatattaatagatggta

SEQ ID NO: 30627 - DNA, 20 bp, Artificial Sequence
  Description of Artificial Sequence: Synthetic oligonucleotide
  Target: FXN; (+) strand; PAM type: YTN; PAM sequence: TTA
atagatggtatctgctagta

SEQ ID NO: 30628 - DNA, 20 bp, Artificial Sequence
  Description of Artificial Sequence: Synthetic oligonucleotide
  Target: FXN; (+) strand; PAM type: YTN; PAM sequence: CTG
ctagtatatacatacacata

SEQ ID NO: 30629 - DNA, 20 bp, Artificial Sequence
  Description of Artificial Sequence: Synthetic oligonucleotide
  Target: FXN; (+) strand; PAM type: YTN; PAM sequence: CTA
gtatatacatacacataatg

SEQ ID NO: 30630 - DNA, 20 bp, Artificial Sequence
  Description of Artificial Sequence: Synthetic oligonucleotide
  Target: FXN; (+) strand; PAM type: YTN; PAM sequence: CTG
tgtgtatctgtatatagcgt

SEQ ID NO: 30631 - DNA, 20 bp, Artificial Sequence
  Description of Artificial Sequence: Synthetic oligonucleotide
  Target: FXN; (+) strand; PAM type: YTN; PAM sequence: CTG
tatatagcgtgtgtgttgtg

SEQ ID NO: 30632 - DNA, 20 bp, Artificial Sequence
  Description of Artificial Sequence: Synthetic oligonucleotide
  Target: FXN; (+) strand; PAM type: YTN; PAM sequence: TTG
tgtgtgtgtgtttgcgcgca

SEQ ID NO: 30633 - DNA, 20 bp, Artificial Sequence
  Description of Artificial Sequence: Synthetic oligonucleotide
  Target: FXN; (+) strand; PAM type: YTN; PAM sequence: TTT
gcgcgcacgggcgcgcgcac

SEQ ID NO: 30634 - DNA, 20 bp, Artificial Sequence
  Description of Artificial Sequence: Synthetic oligonucleotide
  Target: FXN; (+) strand; PAM type: YTN; PAM sequence: TTG
cgcgcacgggcgcgcgcaca

SEQ ID NO: 30635 - DNA, 20 bp, Artificial Sequence
  Description of Artificial Sequence: Synthetic oligonucleotide
  Target: FXN; (+) strand; PAM type: YTN; PAM sequence: CTA
atattttcaaggctggattt

SEQ ID NO: 30636 - DNA, 20 bp, Artificial Sequence
  Description of Artificial Sequence: Synthetic oligonucleotide
  Target: FXN; (+) strand; PAM type: YTN; PAM sequence: TTT
tcaaggctggatttttttga

SEQ ID NO: 30637 - DNA, 20 bp, Artificial Sequence
  Description of Artificial Sequence: Synthetic oligonucleotide
  Target: FXN; (+) strand; PAM type: YTN; PAM sequence: TTT
caaggctggatttttttgaa

SEQ ID NO: 30638 - DNA, 20 bp, Artificial Sequence
  Description of Artificial Sequence: Synthetic oligonucleotide
  Target: FXN; (+) strand; PAM type: YTN; PAM sequence: TTC
aaggctggatttttttgaac

SEQ ID NO: 30639 - DNA, 20 bp, Artificial Sequence
  Description of Artificial Sequence: Synthetic oligonucleotide
  Target: FXN; (+) strand; PAM type: YTN; PAM sequence: CTG
gatttttttgaacgaaatgc

SEQ ID NO: 30640 - DNA, 20 bp, Artificial Sequence
  Description of Artificial Sequence: Synthetic oligonucleotide
  Target: FXN; (+) strand; PAM type: YTN; PAM sequence: TTT
ttttgaacgaaatgctttcc

SEQ ID NO: 30641 - DNA, 20 bp, Artificial Sequence
  Description of Artificial Sequence: Synthetic oligonucleotide
  Target: FXN; (+) strand; PAM type: YTN; PAM sequence: TTT
tttgaacgaaatgctttcct

SEQ ID NO: 30642 - DNA, 20 bp, Artificial Sequence
  Description of Artificial Sequence: Synthetic oligonucleotide
  Target: FXN; (+) strand; PAM type: YTN; PAM sequence: TTT
ttgaacgaaatgctttcctg

SEQ ID NO: 30643 - DNA, 20 bp, Artificial Sequence
  Description of Artificial Sequence: Synthetic oligonucleotide
  Target: FXN; (+) strand; PAM type: YTN; PAM sequence: TTT
tgaacgaaatgctttcctgg

SEQ ID NO: 30644 - DNA, 20 bp, Artificial Sequence
  Description of Artificial Sequence: Synthetic oligonucleotide
  Target: FXN; (+) strand; PAM type: YTN; PAM sequence: TTT
gaacgaaatgctttcctgga

SEQ ID NO: 30645 - DNA, 20 bp, Artificial Sequence
  Description of Artificial Sequence: Synthetic oligonucleotide
  Target: FXN; (+) strand; PAM type: YTN; PAM sequence: TTG
aacgaaatgctttcctggaa

SEQ ID NO: 30646 - DNA, 20 bp, Artificial Sequence
  Description of Artificial Sequence: Synthetic oligonucleotide
  Target: FXN; (+) strand; PAM type: YTN; PAM sequence: CTT
tcctggaacgaggtgaaact

SEQ ID NO: 30647 - DNA, 20 bp, Artificial Sequence
  Description of Artificial Sequence: Synthetic oligonucleotide
  Target: FXN; (+) strand; PAM type: YTN; PAM sequence: TTT
cctggaacgaggtgaaactt

SEQ ID NO: 30648 - DNA, 20 bp, Artificial Sequence
  Description of Artificial Sequence: Synthetic oligonucleotide
  Target: FXN; (+) strand; PAM type: YTN; PAM sequence: TTC
ctggaacgaggtgaaacttt

SEQ ID NO: 30649 - DNA, 20 bp, Artificial Sequence
  Description of Artificial Sequence: Synthetic oligonucleotide
  Target: FXN; (+) strand; PAM type: YTN; PAM sequence: CTG
gaacgaggtgaaactttcag

SEQ ID NO: 30650 - DNA, 20 bp, Artificial Sequence
  Description of Artificial Sequence: Synthetic oligonucleotide
  Target: FXN; (+) strand; PAM type: YTN; PAM sequence: CTT
tcagagctgcagaatagcta

SEQ ID NO: 30651 - DNA, 20 bp, Artificial Sequence
  Description of Artificial Sequence: Synthetic oligonucleotide
  Target: FXN; (+) strand; PAM type: YTN; PAM sequence: TTT
cagagctgcagaatagctag

SEQ ID NO: 30652 - DNA, 20 bp, Artificial Sequence
  Description of Artificial Sequence: Synthetic oligonucleotide
  Target: FXN; (+) strand; PAM type: YTN; PAM sequence: TTC
agagctgcagaatagctaga

SEQ ID NO: 30653 - DNA, 20 bp, Artificial Sequence
  Description of Artificial Sequence: Synthetic oligonucleotide
  Target: FXN; (+) strand; PAM type: YTN; PAM sequence: CTG
cagaatagctagagcagcag

SEQ ID NO: 30654 - DNA, 20 bp, Artificial Sequence
  Description of Artificial Sequence: Synthetic oligonucleotide
  Target: FXN; (+) strand; PAM type: YTN; PAM sequence: CTA
gagcagcaggggccctggct

SEQ ID NO: 30655 - DNA, 20 bp, Artificial Sequence
  Description of Artificial Sequence: Synthetic oligonucleotide
  Target: FXN; (+) strand; PAM type: YTN; PAM sequence: CTG
gcttttggaaactgacccga

SEQ ID NO: 30656 - DNA, 20 bp, Artificial Sequence
  Description of Artificial Sequence: Synthetic oligonucleotide
  Target: FXN; (+) strand; PAM type: YTN; PAM sequence: CTT
ttggaaactgacccgacctt

SEQ ID NO: 30657 - DNA, 20 bp, Artificial Sequence
  Description of Artificial Sequence: Synthetic oligonucleotide
  Target: FXN; (+) strand; PAM type: YTN; PAM sequence: TTT
tggaaactgacccgaccttt

SEQ ID NO: 30658 - DNA, 20 bp, Artificial Sequence
  Description of Artificial Sequence: Synthetic oligonucleotide
  Target: FXN; (+) strand; PAM type: YTN; PAM sequence: TTT
ggaaactgacccgaccttta

SEQ ID NO: 30659 - DNA, 20 bp, Artificial Sequence
  Description of Artificial Sequence: Synthetic oligonucleotide
  Target: FXN; (+) strand; PAM type: YTN; PAM sequence: TTG
gaaactgacccgacctttat

SEQ ID NO: 30660 - DNA, 20 bp, Artificial Sequence
  Description of Artificial Sequence: Synthetic oligonucleotide
  Target: FXN; (+) strand; PAM type: YTN; PAM sequence: CTG
acccgacctttattccagat

SEQ ID NO: 30661 - DNA, 20 bp, Artificial Sequence
  Description of Artificial Sequence: Synthetic oligonucleotide
  Target: FXN; (+) strand; PAM type: YTN; PAM sequence: CTT
tattccagattctgccccac

SEQ ID NO: 30662 - DNA, 20 bp, Artificial Sequence
  Description of Artificial Sequence: Synthetic oligonucleotide
  Target: FXN; (+) strand; PAM type: YTN; PAM sequence: TTT
attccagattctgccccact

SEQ ID NO: 30663 - DNA, 20 bp, Artificial Sequence
  Description of Artificial Sequence: Synthetic oligonucleotide
  Target: FXN; (+) strand; PAM type: YTN; PAM sequence: TTA
ttccagattctgccccactc

SEQ ID NO: 30664 - DNA, 20 bp, Artificial Sequence
  Description of Artificial Sequence: Synthetic oligonucleotide
  Target: FXN; (+) strand; PAM type: YTN; PAM sequence: TTC
cagattctgccccactccgc

SEQ ID NO: 30665 - DNA, 20 bp, Artificial Sequence
  Description of Artificial Sequence: Synthetic oligonucleotide
  Target: FXN; (+) strand; PAM type: YTN; PAM sequence: TTC
tgccccactccgcagagctg

SEQ ID NO: 30666 - DNA, 20 bp, Artificial Sequence
  Description of Artificial Sequence: Synthetic oligonucleotide
  Target: FXN; (+) strand; PAM type: YTN; PAM sequence: CTG
ccccactccgcagagctgtg

SEQ ID NO: 30667 - DNA, 20 bp, Artificial Sequence
  Description of Artificial Sequence: Synthetic oligonucleotide
  Target: FXN; (+) strand; PAM type: YTN; PAM sequence: CTC
cgcagagctgtgtgaccttg

SEQ ID NO: 30668 - DNA, 20 bp, Artificial Sequence
  Description of Artificial Sequence: Synthetic oligonucleotide
  Target: FXN; (+) strand; PAM type: YTN; PAM sequence: CTG
tgtgaccttgggggattccc

SEQ ID NO: 30669 - DNA, 20 bp, Artificial Sequence
  Description of Artificial Sequence: Synthetic oligonucleotide
  Target: FXN; (+) strand; PAM type: YTN; PAM sequence: CTT
gggggattcccctaacctct

SEQ ID NO: 30670 - DNA, 20 bp, Artificial Sequence
  Description of Artificial Sequence: Synthetic oligonucleotide
  Target: FXN; (+) strand; PAM type: YTN; PAM sequence: TTG
ggggattcccctaacctctc

SEQ ID NO: 30671 - DNA, 20 bp, Artificial Sequence
  Description of Artificial Sequence: Synthetic oligonucleotide
  Target: FXN; (+) strand; PAM type: YTN; PAM sequence: TTC
ccctaacctctctgagacgt

SEQ ID NO: 30672 - DNA, 20 bp, Artificial Sequence
  Description of Artificial Sequence: Synthetic oligonucleotide
  Target: FXN; (+) strand; PAM type: YTN; PAM sequence: CTA
acctctctgagacgtggctt

SEQ ID NO: 30673 - DNA, 20 bp, Artificial Sequence
  Description of Artificial Sequence: Synthetic oligonucleotide
  Target: FXN; (+) strand; PAM type: YTN; PAM sequence: CTC
tctgagacgtggctttgttt

SEQ ID NO: 30674 - DNA, 20 bp, Artificial Sequence
  Description of Artificial Sequence: Synthetic oligonucleotide
  Target: FXN; (+) strand; PAM type: YTN; PAM sequence: CTC
tgagacgtggctttgttttc

SEQ ID NO: 30675 - DNA, 20 bp, Artificial Sequence
  Description of Artificial Sequence: Synthetic oligonucleotide
  Target: FXN; (+) strand; PAM type: YTN; PAM sequence: CTG
agacgtggctttgttttctg

SEQ ID NO: 30676 - DNA, 20 bp, Artificial Sequence
  Description of Artificial Sequence: Synthetic oligonucleotide
  Target: FXN; (+) strand; PAM type: YTN; PAM sequence: CTT
tgttttctgtagggagaaga

SEQ ID NO: 30677 - DNA, 20 bp, Artificial Sequence
  Description of Artificial Sequence: Synthetic oligonucleotide
  Target: FXN; (+) strand; PAM type: YTN; PAM sequence: TTT
gttttctgtagggagaagat

SEQ ID NO: 30678 - DNA, 20 bp, Artificial Sequence
  Description of Artificial Sequence: Synthetic oligonucleotide
  Target: FXN; (+) strand; PAM type: YTN; PAM sequence: TTG
ttttctgtagggagaagata

SEQ ID NO: 30679 - DNA, 20 bp, Artificial Sequence
  Description of Artificial Sequence: Synthetic oligonucleotide
  Target: FXN; (+) strand; PAM type: YTN; PAM sequence: TTT
tctgtagggagaagataaag

SEQ ID NO: 30680 - DNA, 20 bp, Artificial Sequence
  Description of Artificial Sequence: Synthetic oligonucleotide
  Target: FXN; (+) strand; PAM type: YTN; PAM sequence: TTT
ctgtagggagaagataaagg

SEQ ID NO: 30681 - DNA, 20 bp, Artificial Sequence
  Description of Artificial Sequence: Synthetic oligonucleotide
  Target: FXN; (+) strand; PAM type: YTN; PAM sequence: TTC
tgtagggagaagataaaggt

SEQ ID NO: 30682 - DNA, 20 bp, Artificial Sequence
  Description of Artificial Sequence: Synthetic oligonucleotide
  Target: FXN; (+) strand; PAM type: YTN; PAM sequence: CTG
tagggagaagataaaggtga

SEQ ID NO: 30683 - DNA, 20 bp, Artificial Sequence
  Description of Artificial Sequence: Synthetic oligonucleotide
  Target: FXN; (+) strand; PAM type: YTN; PAM sequence: TTT
tgcggacctggtgtgaggat

SEQ ID NO: 30684 - DNA, 20 bp, Artificial Sequence
  Description of Artificial Sequence: Synthetic oligonucleotide
  Target: FXN; (+) strand; PAM type: YTN; PAM sequence: TTT
gcggacctggtgtgaggatt

SEQ ID NO: 30685 - DNA, 20 bp, Artificial Sequence
  Description of Artificial Sequence: Synthetic oligonucleotide
  Target: FXN; (+) strand; PAM type: YTN; PAM sequence: TTG
cggacctggtgtgaggatta

SEQ ID NO: 30686 - DNA, 20 bp, Artificial Sequence
  Description of Artificial Sequence: Synthetic oligonucleotide
  Target: FXN; (+) strand; PAM type: YTN; PAM sequence: CTG
gtgtgaggattaaatgggaa

SEQ ID NO: 30687 - DNA, 20 bp, Artificial Sequence
  Description of Artificial Sequence: Synthetic oligonucleotide
  Target: FXN; (+) strand; PAM type: YTN; PAM sequence: TTA
aatgggaataacatagataa

SEQ ID NO: 30688 - DNA, 20 bp, Artificial Sequence
  Description of Artificial Sequence: Synthetic oligonucleotide
  Target: FXN; (+) strand; PAM type: YTN; PAM sequence: CTT
cagaacttcaaattagttcc

SEQ ID NO: 30689 - DNA, 20 bp, Artificial Sequence
  Description of Artificial Sequence: Synthetic oligonucleotide
  Target: FXN; (+) strand; PAM type: YTN; PAM sequence: TTC
agaacttcaaattagttccc

SEQ ID NO: 30690 - DNA, 20 bp, Artificial Sequence
  Description of Artificial Sequence: Synthetic oligonucleotide
  Target: FXN; (+) strand; PAM type: YTN; PAM sequence: CTT
caaattagttcccctttctt

SEQ ID NO: 30691 - DNA, 20 bp, Artificial Sequence
  Description of Artificial Sequence: Synthetic oligonucleotide
  Target: FXN; (+) strand; PAM type: YTN; PAM sequence: TTC
aaattagttcccctttcttc

SEQ ID NO: 30692 - DNA, 20 bp, Artificial Sequence
  Description of Artificial Sequence: Synthetic oligonucleotide
  Target: FXN; (+) strand; PAM type: YTN; PAM sequence: TTA
gttcccctttcttcctttgg

SEQ ID NO: 30693 - DNA, 20 bp, Artificial Sequence
  Description of Artificial Sequence: Synthetic oligonucleotide
  Target: FXN; (+) strand; PAM type: YTN; PAM sequence: TTC
ccctttcttcctttgggggg

SEQ ID NO: 30694 - DNA, 20 bp, Artificial Sequence
  Description of Artificial Sequence: Synthetic oligonucleotide
  Target: FXN; (+) strand; PAM type: YTN; PAM sequence: CTT
tcttcctttggggggtacaa

SEQ ID NO: 30695 - DNA, 20 bp, Artificial Sequence
  Description of Artificial Sequence: Synthetic oligonucleotide
  Target: FXN; (+) strand; PAM type: YTN; PAM sequence: TTT
cttcctttggggggtacaaa

SEQ ID NO: 30696 - DNA, 20 bp, Artificial Sequence
  Description of Artificial Sequence: Synthetic oligonucleotide
  Target: FXN; (+) strand; PAM type: YTN; PAM sequence: TTC
ttcctttggggggtacaaag

SEQ ID NO: 30697 - DNA, 20 bp, Artificial Sequence
  Description of Artificial Sequence: Synthetic oligonucleotide
  Target: FXN; (+) strand; PAM type: YTN; PAM sequence: CTT
cctttggggggtacaaagaa

SEQ ID NO: 30698 - DNA, 20 bp, Artificial Sequence
  Description of Artificial Sequence: Synthetic oligonucleotide
  Target: FXN; (+) strand; PAM type: YTN; PAM sequence: TTC
ctttggggggtacaaagaaa

SEQ ID NO: 30699 - DNA, 20 bp, Artificial Sequence
  Description of Artificial Sequence: Synthetic oligonucleotide
  Target: FXN; (+) strand; PAM type: YTN; PAM sequence: CTT
tggggggtacaaagaaatat

SEQ ID NO: 30700 - DNA, 20 bp, Artificial Sequence
  Description of Artificial Sequence: Synthetic oligonucleotide
  Target: FXN; (+) strand; PAM type: YTN; PAM sequence: TTT
ggggggtacaaagaaatatc

SEQ ID NO: 30701 - DNA, 20 bp, Artificial Sequence
  Description of Artificial Sequence: Synthetic oligonucleotide
  Target: FXN; (+) strand; PAM type: YTN; PAM sequence: TTG
gggggtacaaagaaatatct

SEQ ID NO: 30702 - DNA, 20 bp, Artificial Sequence
  Description of Artificial Sequence: Synthetic oligonucleotide
  Target: FXN; (+) strand; PAM type: YTN; PAM sequence: CTG
acccagttacgccacggctt

SEQ ID NO: 30703 - DNA, 20 bp, Artificial Sequence
  Description of Artificial Sequence: Synthetic oligonucleotide
  Target: FXN; (+) strand; PAM type: YTN; PAM sequence: TTA
cgccacggcttgaaaggagg

SEQ ID NO: 30704 - DNA, 20 bp, Artificial Sequence
  Description of Artificial Sequence: Synthetic oligonucleotide
  Target: FXN; (+) strand; PAM type: YTN; PAM sequence: CTT
gaaaggaggaaacccaaaga

SEQ ID NO: 30705 - DNA, 20 bp, Artificial Sequence
  Description of Artificial Sequence: Synthetic oligonucleotide
  Target: FXN; (+) strand; PAM type: YTN; PAM sequence: TTG
aaaggaggaaacccaaagaa

SEQ ID NO: 30706 - DNA, 20 bp, Artificial Sequence
  Description of Artificial Sequence: Synthetic oligonucleotide
  Target: FXN; (+) strand; PAM type: YTN; PAM sequence: CTG
tggggatgaggaagattcct

SEQ ID NO: 30707 - DNA, 20 bp, Artificial Sequence
  Description of Artificial Sequence: Synthetic oligonucleotide
  Target: FXN; (+) strand; PAM type: YTN; PAM sequence: TTC
ctcaaggggaggacatggta

SEQ ID NO: 30708 - DNA, 20 bp, Artificial Sequence
  Description of Artificial Sequence: Synthetic oligonucleotide
  Target: FXN; (+) strand; PAM type: YTN; PAM sequence: CTC
aaggggaggacatggtattt

SEQ ID NO: 30709 - DNA, 20 bp, Artificial Sequence
  Description of Artificial Sequence: Synthetic oligonucleotide
  Target: FXN; (+) strand; PAM type: YTN; PAM sequence: TTT
aatgagggtcttgaagatgc

SEQ ID NO: 30710 - DNA, 20 bp, Artificial Sequence
  Description of Artificial Sequence: Synthetic oligonucleotide
  Target: FXN; (+) strand; PAM type: YTN; PAM sequence: TTA
atgagggtcttgaagatgcc

SEQ ID NO: 30711 - DNA, 20 bp, Artificial Sequence
  Description of Artificial Sequence: Synthetic oligonucleotide
  Target: FXN; (+) strand; PAM type: YTN; PAM sequence: CTT
gaagatgccaaggaagtggt

SEQ ID NO: 30712 - DNA, 20 bp, Artificial Sequence
  Description of Artificial Sequence: Synthetic oligonucleotide
  Target: FXN; (+) strand; PAM type: YTN; PAM sequence: TTG
aagatgccaaggaagtggta

SEQ ID NO: 30713 - DNA, 20 bp, Artificial Sequence
  Description of Artificial Sequence: Synthetic oligonucleotide
  Target: FXN; (+) strand; PAM type: YTN; PAM sequence: TTT
cacgaggagggaaccgtctg

SEQ ID NO: 30714 - DNA, 20 bp, Artificial Sequence
  Description of Artificial Sequence: Synthetic oligonucleotide
  Target: FXN; (+) strand; PAM type: YTN; PAM sequence: TTC
acgaggagggaaccgtctgg

SEQ ID NO: 30715 - DNA, 20 bp, Artificial Sequence
  Description of Artificial Sequence: Synthetic oligonucleotide
  Target: FXN; (+) strand; PAM type: YTN; PAM sequence: CTG
ggcaaaggccaggaaggcgg

SEQ ID NO: 30716 - DNA, 20 bp, Artificial Sequence
  Description of Artificial Sequence: Synthetic oligonucleotide
  Target: FXN; (+) strand; PAM type: YTN; PAM sequence: CTT
cagagtggctggtacgccgc

SEQ ID NO: 30717 - DNA, 20 bp, Artificial Sequence
  Description of Artificial Sequence: Synthetic oligonucleotide
  Target: FXN; (+) strand; PAM type: YTN; PAM sequence: TTC
agagtggctggtacgccgca

SEQ ID NO: 30718 - DNA, 20 bp, Artificial Sequence
  Description of Artificial Sequence: Synthetic oligonucleotide
  Target: FXN; (+) strand; PAM type: YTN; PAM sequence: CTG
gtacgccgcatgtattaggg

SEQ ID NO: 30719 - DNA, 20 bp, Artificial Sequence
  Description of Artificial Sequence: Synthetic oligonucleotide
  Target: FXN; (+) strand; PAM type: YTN; PAM sequence: TTA
ggggagatgaaagaggcagg

SEQ ID NO: 30720 - DNA, 20 bp, Artificial Sequence
  Description of Artificial Sequence: Synthetic oligonucleotide
  Target: FXN; (+) strand; PAM type: YTN; PAM sequence: TTT
gtgttgctctccggagtttg

SEQ ID NO: 30721 - DNA, 20 bp, Artificial Sequence
  Description of Artificial Sequence: Synthetic oligonucleotide
  Target: FXN; (+) strand; PAM type: YTN; PAM sequence: TTG
tgttgctctccggagtttgt

SEQ ID NO: 30722 - DNA, 20 bp, Artificial Sequence
  Description of Artificial Sequence: Synthetic oligonucleotide
  Target: FXN; (+) strand; PAM type: YTN; PAM sequence: TTG
ctctccggagtttgtacttt

SEQ ID NO: 30723 - DNA, 20 bp, Artificial Sequence
  Description of Artificial Sequence: Synthetic oligonucleotide
  Target: FXN; (+) strand; PAM type: YTN; PAM sequence: CTC
tccggagtttgtactttagg

SEQ ID NO: 30724 - DNA, 20 bp, Artificial Sequence
  Description of Artificial Sequence: Synthetic oligonucleotide
  Target: FXN; (+) strand; PAM type: YTN; PAM sequence: CTC
cggagtttgtactttaggct

SEQ ID NO: 30725 - DNA, 20 bp, Artificial Sequence
  Description of Artificial Sequence: Synthetic oligonucleotide
  Target: FXN; (+) strand; PAM type: YTN; PAM sequence: TTT
gtactttaggcttgaacttc

SEQ ID NO: 30726 - DNA, 20 bp, Artificial Sequence
  Description of Artificial Sequence: Synthetic oligonucleotide
  Target: FXN; (+) strand; PAM type: YTN; PAM sequence: TTG
tactttaggcttgaacttcc

SEQ ID NO: 30727 - DNA, 20 bp, Artificial Sequence
  Description of Artificial Sequence: Synthetic oligonucleotide
  Target: FXN; (+) strand; PAM type: YTN; PAM sequence: CTT
taggcttgaacttcccacac

SEQ ID NO: 30728 - DNA, 20 bp, Artificial Sequence
  Description of Artificial Sequence: Synthetic oligonucleotide
  Target: FXN; (+) strand; PAM type: YTN; PAM sequence: TTT
aggcttgaacttcccacacg

SEQ ID NO: 30729 - DNA, 20 bp, Artificial Sequence
  Description of Artificial Sequence: Synthetic oligonucleotide
  Target: FXN; (+) strand; PAM type: YTN; PAM sequence: TTA
ggcttgaacttcccacacgt

SEQ ID NO: 30730 - DNA, 20 bp, Artificial Sequence
  Description of Artificial Sequence: Synthetic oligonucleotide
  Target: FXN; (+) strand; PAM type: YTN; PAM sequence: CTT
gaacttcccacacgtgttat

SEQ ID NO: 30731 - DNA, 20 bp, Artificial Sequence
  Description of Artificial Sequence: Synthetic oligonucleotide
  Target: FXN; (+) strand; PAM type: YTN; PAM sequence: TTG
aacttcccacacgtgttatt

SEQ ID NO: 30732 - DNA, 20 bp, Artificial Sequence
  Description of Artificial Sequence: Synthetic oligonucleotide
  Target: FXN; (+) strand; PAM type: YTN; PAM sequence: CTT
cccacacgtgttatttggcc

SEQ ID NO: 30733 - DNA, 20 bp, Artificial Sequence
  Description of Artificial Sequence: Synthetic oligonucleotide
  Target: FXN; (+) strand; PAM type: YTN; PAM sequence: TTC
ccacacgtgttatttggccc

SEQ ID NO: 30734 - DNA, 20 bp, Artificial Sequence
  Description of Artificial Sequence: Synthetic oligonucleotide
  Target: FXN; (+) strand; PAM type: YTN; PAM sequence: TTA
tttggcccacattgtgtttg

SEQ ID NO: 30735 - DNA, 20 bp, Artificial Sequence
  Description of Artificial Sequence: Synthetic oligonucleotide
  Target: FXN; (+) strand; PAM type: YTN; PAM sequence: TTT
ggcccacattgtgtttgaag

SEQ ID NO: 30736 - DNA, 20 bp, Artificial Sequence
  Description of Artificial Sequence: Synthetic oligonucleotide
  Target: FXN; (+) strand; PAM type: YTN; PAM sequence: TTG
gcccacattgtgtttgaaga

SEQ ID NO: 30737 - DNA, 20 bp, Artificial Sequence
  Description of Artificial Sequence: Synthetic oligonucleotide
  Target: FXN; (+) strand; PAM type: YTN; PAM sequence: TTG
tgtttgaagaaactttggga

SEQ ID NO: 30738 - DNA, 20 bp, Artificial Sequence
  Description of Artificial Sequence: Synthetic oligonucleotide
  Target: FXN; (+) strand; PAM type: YTN; PAM sequence: TTT
gaagaaactttgggattggt

SEQ ID NO: 30739 - DNA, 20 bp, Artificial Sequence
  Description of Artificial Sequence: Synthetic oligonucleotide
  Target: FXN; (+) strand; PAM type: YTN; PAM sequence: TTG
aagaaactttgggattggtt

SEQ ID NO: 30740 - DNA, 20 bp, Artificial Sequence
  Description of Artificial Sequence: Synthetic oligonucleotide
  Target: FXN; (+) strand; PAM type: YTN; PAM sequence: CTT
tgggattggttgccagtgct

SEQ ID NO: 30741 - DNA, 20 bp, Artificial Sequence
  Description of Artificial Sequence: Synthetic oligonucleotide
  Target: FXN; (+) strand; PAM type: YTN; PAM sequence: TTT
gggattggttgccagtgctt

SEQ ID NO: 30742 - DNA, 20 bp, Artificial Sequence
  Description of Artificial Sequence: Synthetic oligonucleotide
  Target: FXN; (+) strand; PAM type: YTN; PAM sequence: TTG
ggattggttgccagtgctta

SEQ ID NO: 30743 - DNA, 20 bp, Artificial Sequence
  Description of Artificial Sequence: Synthetic oligonucleotide
  Target: FXN; (+) strand; PAM type: YTN; PAM sequence: TTG
gttgccagtgcttaaaagtt

SEQ ID NO: 30744 - DNA, 20 bp, Artificial Sequence
  Description of Artificial Sequence: Synthetic oligonucleotide
  Target: FXN; (+) strand; PAM type: YTN; PAM sequence: TTG
ccagtgcttaaaagttagga

SEQ ID NO: 30745 - DNA, 20 bp, Artificial Sequence
  Description of Artificial Sequence: Synthetic oligonucleotide
  Target: FXN; (+) strand; PAM type: YTN; PAM sequence: CTT
aaaagttaggacttagaaaa

SEQ ID NO: 30746 - DNA, 20 bp, Artificial Sequence
  Description of Artificial Sequence: Synthetic oligonucleotide
  Target: FXN; (+) strand; PAM type: YTN; PAM sequence: TTA
aaagttaggacttagaaaat

SEQ ID NO: 30747 - DNA, 20 bp, Artificial Sequence
  Description of Artificial Sequence: Synthetic oligonucleotide
  Target: FXN; (+) strand; PAM type: YTN; PAM sequence: TTA
ggacttagaaaatggatttc

SEQ ID NO: 30748 - DNA, 20 bp, Artificial Sequence
  Description of Artificial Sequence: Synthetic oligonucleotide
  Target: FXN; (+) strand; PAM type: YTN; PAM sequence: CTT
agaaaatggatttcctggca

SEQ ID NO: 30749 - DNA, 20 bp, Artificial Sequence
  Description of Artificial Sequence: Synthetic oligonucleotide
  Target: FXN; (+) strand; PAM type: YTN; PAM sequence: TTA
gaaaatggatttcctggcag

SEQ ID NO: 30750 - DNA, 20 bp, Artificial Sequence
  Description of Artificial Sequence: Synthetic oligonucleotide
  Target: FXN; (+) strand; PAM type: YTN; PAM sequence: TTT
cctggcaggacgcggtggct

SEQ ID NO: 30751 - DNA, 20 bp, Artificial Sequence
  Description of Artificial Sequence: Synthetic oligonucleotide
  Target: FXN; (+) strand; PAM type: YTN; PAM sequence: TTC
ctggcaggacgcggtggctc

SEQ ID NO: 30752 - DNA, 20 bp, Artificial Sequence
  Description of Artificial Sequence: Synthetic oligonucleotide
  Target: FXN; (+) strand; PAM type: YTN; PAM sequence: CTG
gcaggacgcggtggctcatg

SEQ ID NO: 30753 - DNA, 20 bp, Artificial Sequence
  Description of Artificial Sequence: Synthetic oligonucleotide
  Target: FXN; (+) strand; PAM type: YTN; PAM sequence: CTC
atgcccataatctcagcact

SEQ ID NO: 30754 - DNA, 20 bp, Artificial Sequence
  Description of Artificial Sequence: Synthetic oligonucleotide
  Target: FXN; (+) strand; PAM type: YTN; PAM sequence: CTC
agcactttgggaggcctagg

SEQ ID NO: 30755 - DNA, 20 bp, Artificial Sequence
  Description of Artificial Sequence: Synthetic oligonucleotide
  Target: FXN; (+) strand; PAM type: YTN; PAM sequence: CTT
tgggaggcctaggaaggtgg

SEQ ID NO: 30756 - DNA, 20 bp, Artificial Sequence
  Description of Artificial Sequence: Synthetic oligonucleotide
  Target: FXN; (+) strand; PAM type: YTN; PAM sequence: TTT
gggaggcctaggaaggtgga

SEQ ID NO: 30757 - DNA, 20 bp, Artificial Sequence
  Description of Artificial Sequence: Synthetic oligonucleotide
  Target: FXN; (+) strand; PAM type: YTN; PAM sequence: TTG
ggaggcctaggaaggtggat

SEQ ID NO: 30758 - DNA, 20 bp, Artificial Sequence
  Description of Artificial Sequence: Synthetic oligonucleotide
  Target: FXN; (+) strand; PAM type: YTN; PAM sequence: CTA
ggaaggtggatcacctgagg

SEQ ID NO: 30759 - DNA, 20 bp, Artificial Sequence
  Description of Artificial Sequence: Synthetic oligonucleotide
  Target: FXN; (+) strand; PAM type: YTN; PAM sequence: CTG
aggtccggagttcaagacta

SEQ ID NO: 30760 - DNA, 20 bp, Artificial Sequence
  Description of Artificial Sequence: Synthetic oligonucleotide
  Target: FXN; (+) strand; PAM type: YTN; PAM sequence: TTC
aagactaacctggccaacat

SEQ ID NO: 30761 - DNA, 20 bp, Artificial Sequence
  Description of Artificial Sequence: Synthetic oligonucleotide
  Target: FXN; (+) strand; PAM type: YTN; PAM sequence: CTA
acctggccaacatggtgaaa

SEQ ID NO: 30762 - DNA, 20 bp, Artificial Sequence
  Description of Artificial Sequence: Synthetic oligonucleotide
  Target: FXN; (+) strand; PAM type: YTN; PAM sequence: CTG
gccaacatggtgaaacccag

SEQ ID NO: 30763 - DNA, 20 bp, Artificial Sequence
  Description of Artificial Sequence: Synthetic oligonucleotide
  Target: FXN; (+) strand; PAM type: YTN; PAM sequence: CTA
ctaaaaaatacaaaaaaaaa

SEQ ID NO: 30764 - DNA, 20 bp, Artificial Sequence
  Description of Artificial Sequence: Synthetic oligonucleotide
  Target: FXN; (+) strand; PAM type: YTN; PAM sequence: CTA
aaaaatacaaaaaaaaaaaa

SEQ ID NO: 30765 - DNA, 20 bp, Artificial Sequence
  Description of Artificial Sequence: Synthetic oligonucleotide
  Target: FXN; (+) strand; PAM type: YTN; PAM sequence: TTA
gccgggcgtggtgtcgcgcg

SEQ ID NO: 30766 - DNA, 20 bp, Artificial Sequence
  Description of Artificial Sequence: Synthetic oligonucleotide
  Target: FXN; (+) strand; PAM type: YTN; PAM sequence: CTG
taatcccagctactccagag

SEQ ID NO: 30767 - DNA, 20 bp, Artificial Sequence
  Description of Artificial Sequence: Synthetic oligonucleotide
  Target: FXN; (+) strand; PAM type: YTN; PAM sequence: CTA
ctccagaggctgcggcagga

SEQ ID NO: 30768 - DNA, 20 bp, Artificial Sequence
  Description of Artificial Sequence: Synthetic oligonucleotide
  Target: FXN; (+) strand; PAM type: YTN; PAM sequence: CTC
cagaggctgcggcaggagaa

SEQ ID NO: 30769 - DNA, 20 bp, Artificial Sequence
  Description of Artificial Sequence: Synthetic oligonucleotide
  Target: FXN; (+) strand; PAM type: YTN; PAM sequence: CTG
cggcaggagaatcgcttgag

SEQ ID NO: 30770 - DNA, 20 bp, Artificial Sequence
  Description of Artificial Sequence: Synthetic oligonucleotide
  Target: FXN; (+) strand; PAM type: YTN; PAM sequence: CTT
gagcccgggaggcagaggtt

SEQ ID NO: 30771 - DNA, 20 bp, Artificial Sequence
  Description of Artificial Sequence: Synthetic oligonucleotide
  Target: FXN; (+) strand; PAM type: YTN; PAM sequence: TTG
agcccgggaggcagaggttg

SEQ ID NO: 30772 - DNA, 20 bp, Artificial Sequence
  Description of Artificial Sequence: Synthetic oligonucleotide
  Target: FXN; (+) strand; PAM type: YTN; PAM sequence: TTG
cattaagccaagatcgccca

SEQ ID NO: 30773 - DNA, 20 bp, Artificial Sequence
  Description of Artificial Sequence: Synthetic oligonucleotide
  Target: FXN; (+) strand; PAM type: YTN; PAM sequence: TTA
agccaagatcgcccaatgca

SEQ ID NO: 30774 - DNA, 20 bp, Artificial Sequence
  Description of Artificial Sequence: Synthetic oligonucleotide
  Target: FXN; (+) strand; PAM type: YTN; PAM sequence: CTC
cggcctgggcgacagagcaa

SEQ ID NO: 30775 - DNA, 20 bp, Artificial Sequence
  Description of Artificial Sequence: Synthetic oligonucleotide
  Target: FXN; (+) strand; PAM type: YTN; PAM sequence: CTG
ggcgacagagcaagactccg

SEQ ID NO: 30776 - DNA, 20 bp, Artificial Sequence
  Description of Artificial Sequence: Synthetic oligonucleotide
  Target: FXN; (+) strand; PAM type: YTN; PAM sequence: CTC
cgtctcaaaaaataataata

SEQ ID NO: 30777 - DNA, 20 bp, Artificial Sequence
  Description of Artificial Sequence: Synthetic oligonucleotide
  Target: FXN; (+) strand; PAM type: YTN; PAM sequence: CTC
aaaaaataataataataaat

SEQ ID NO: 30778 - DNA, 20 bp, Artificial Sequence
  Description of Artificial Sequence: Synthetic oligonucleotide
  Target: FXN; (+) strand; PAM type: YTN; PAM sequence: TTT
cccagcatctctggaaaaat

SEQ ID NO: 30779 - DNA, 20 bp, Artificial Sequence
  Description of Artificial Sequence: Synthetic oligonucleotide
  Target: FXN; (+) strand; PAM type: YTN; PAM sequence: TTC
ccagcatctctggaaaaata

SEQ ID NO: 30780 - DNA, 20 bp, Artificial Sequence
  Description of Artificial Sequence: Synthetic oligonucleotide
  Target: FXN; (+) strand; PAM type: YTN; PAM sequence: CTC
tggaaaaataggcaagtgtg

SEQ ID NO: 30781 - DNA, 20 bp, Artificial Sequence
  Description of Artificial Sequence: Synthetic oligonucleotide
  Target: FXN; (+) strand; PAM type: YTN; PAM sequence: CTG
gaaaaataggcaagtgtggc

SEQ ID NO: 30782 - DNA, 20 bp, Artificial Sequence
  Description of Artificial Sequence: Synthetic oligonucleotide
  Target: FXN; (+) strand; PAM type: YTN; PAM sequence: CTT
agatctcctctaggaaagca

SEQ ID NO: 30783 - DNA, 20 bp, Artificial Sequence
  Description of Artificial Sequence: Synthetic oligonucleotide
  Target: FXN; (+) strand; PAM type: YTN; PAM sequence: TTA
gatctcctctaggaaagcag

SEQ ID NO: 30784 - DNA, 20 bp, Artificial Sequence
  Description of Artificial Sequence: Synthetic oligonucleotide
  Target: FXN; (+) strand; PAM type: YTN; PAM sequence: CTC
ctctaggaaagcagacattt

SEQ ID NO: 30785 - DNA, 20 bp, Artificial Sequence
  Description of Artificial Sequence: Synthetic oligonucleotide
  Target: FXN; (+) strand; PAM type: YTN; PAM sequence: CTC
taggaaagcagacatttatt

SEQ ID NO: 30786 - DNA, 20 bp, Artificial Sequence
  Description of Artificial Sequence: Synthetic oligonucleotide
  Target: FXN; (+) strand; PAM type: YTN; PAM sequence: CTA
ggaaagcagacatttattac

SEQ ID NO: 30787 - DNA, 20 bp, Artificial Sequence
  Description of Artificial Sequence: Synthetic oligonucleotide
  Target: FXN; (+) strand; PAM type: YTN; PAM sequence: TTT
attacttggcttctgtgcac

SEQ ID NO: 30788 - DNA, 20 bp, Artificial Sequence
  Description of Artificial Sequence: Synthetic oligonucleotide
  Target: FXN; (+) strand; PAM type: YTN; PAM sequence: TTA
ttacttggcttctgtgcact

SEQ ID NO: 30789 - DNA, 20 bp, Artificial Sequence
  Description of Artificial Sequence: Synthetic oligonucleotide
  Target: FXN; (+) strand; PAM type: YTN; PAM sequence: TTA
cttggcttctgtgcactatc

SEQ ID NO: 30790 - DNA, 20 bp, Artificial Sequence
  Description of Artificial Sequence: Synthetic oligonucleotide
  Target: FXN; (+) strand; PAM type: YTN; PAM sequence: CTT
ggcttctgtgcactatctga

SEQ ID NO: 30791 - DNA, 20 bp, Artificial Sequence
  Description of Artificial Sequence: Synthetic oligonucleotide
  Target: FXN; (+) strand; PAM type: YTN; PAM sequence: TTG
gcttctgtgcactatctgag

SEQ ID NO: 30792 - DNA, 20 bp, Artificial Sequence
  Description of Artificial Sequence: Synthetic oligonucleotide
  Target: FXN; (+) strand; PAM type: YTN; PAM sequence: CTT
ctgtgcactatctgagctgc

SEQ ID NO: 30793 - DNA, 20 bp, Artificial Sequence
  Description of Artificial Sequence: Synthetic oligonucleotide
  Target: FXN; (+) strand; PAM type: YTN; PAM sequence: TTC
tgtgcactatctgagctgcc

SEQ ID NO: 30794 - DNA, 20 bp, Artificial Sequence
  Description of Artificial Sequence: Synthetic oligonucleotide
  Target: FXN; (+) strand; PAM type: YTN; PAM sequence: CTG
tgcactatctgagctgccac

SEQ ID NO: 30795 - DNA, 20 bp, Artificial Sequence
  Description of Artificial Sequence: Synthetic oligonucleotide
  Target: FXN; (+) strand; PAM type: YTN; PAM sequence: CTA
tctgagctgccacgtattgg

SEQ ID NO: 30796 - DNA, 20 bp, Artificial Sequence
  Description of Artificial Sequence: Synthetic oligonucleotide
  Target: FXN; (+) strand; PAM type: YTN; PAM sequence: CTG
agctgccacgtattgggctt

SEQ ID NO: 30797 - DNA, 20 bp, Artificial Sequence
  Description of Artificial Sequence: Synthetic oligonucleotide
  Target: FXN; (+) strand; PAM type: YTN; PAM sequence: CTG
ccacgtattgggcttccacc

SEQ ID NO: 30798 - DNA, 20 bp, Artificial Sequence
  Description of Artificial Sequence: Synthetic oligonucleotide
  Target: FXN; (+) strand; PAM type: YTN; PAM sequence: TTG
ggcttccacccctgcctgtg

SEQ ID NO: 30799 - DNA, 20 bp, Artificial Sequence
  Description of Artificial Sequence: Synthetic oligonucleotide
  Target: FXN; (+) strand; PAM type: YTN; PAM sequence: CTT
ccacccctgcctgtgtggac

SEQ ID NO: 30800 - DNA, 20 bp, Artificial Sequence
  Description of Artificial Sequence: Synthetic oligonucleotide
  Target: FXN; (+) strand; PAM type: YTN; PAM sequence: TTC
cacccctgcctgtgtggaca

SEQ ID NO: 30801 - DNA, 20 bp, Artificial Sequence
  Description of Artificial Sequence: Synthetic oligonucleotide
  Target: FXN; (+) strand; PAM type: YTN; PAM sequence: CTG
cctgtgtggacagcatgggt

SEQ ID NO: 30802 - DNA, 20 bp, Artificial Sequence
  Description of Artificial Sequence: Synthetic oligonucleotide
  Target: FXN; (+) strand; PAM type: YTN; PAM sequence: CTG
tgtggacagcatgggttgtc

SEQ ID NO: 30803 - DNA, 20 bp, Artificial Sequence
  Description of Artificial Sequence: Synthetic oligonucleotide
  Target: FXN; (+) strand; PAM type: YTN; PAM sequence: TTG
tcagcagagttgtgttttgt

SEQ ID NO: 30804 - DNA, 20 bp, Artificial Sequence
  Description of Artificial Sequence: Synthetic oligonucleotide
  Target: FXN; (+) strand; PAM type: YTN; PAM sequence: TTG
tgttttgttttgtttttttg

SEQ ID NO: 30805 - DNA, 20 bp, Artificial Sequence
  Description of Artificial Sequence: Synthetic oligonucleotide
  Target: FXN; (+) strand; PAM type: YTN; PAM sequence: TTT
tgttttgtttttttgagaca

SEQ ID NO: 30806 - DNA, 20 bp, Artificial Sequence
  Description of Artificial Sequence: Synthetic oligonucleotide
  Target: FXN; (+) strand; PAM type: YTN; PAM sequence: TTT
gttttgtttttttgagacag

SEQ ID NO: 30807 - DNA, 20 bp, Artificial Sequence
  Description of Artificial Sequence: Synthetic oligonucleotide
  Target: FXN; (+) strand; PAM type: YTN; PAM sequence: TTG
ttttgtttttttgagacaga

SEQ ID NO: 30808 - DNA, 20 bp, Artificial Sequence
  Description of Artificial Sequence: Synthetic oligonucleotide
  Target: FXN; (+) strand; PAM type: YTN; PAM sequence: TTT
tgtttttttgagacagagtt

SEQ ID NO: 30809 - DNA, 20 bp, Artificial Sequence
  Description of Artificial Sequence: Synthetic oligonucleotide
  Target: FXN; (+) strand; PAM type: YTN; PAM sequence: TTT
gtttttttgagacagagttt

SEQ ID NO: 30810 - DNA, 20 bp, Artificial Sequence
  Description of Artificial Sequence: Synthetic oligonucleotide
  Target: FXN; (+) strand; PAM type: YTN; PAM sequence: TTG
tttttttgagacagagtttc

SEQ ID NO: 30811 - DNA, 20 bp, Artificial Sequence
  Description of Artificial Sequence: Synthetic oligonucleotide
  Target: FXN; (+) strand; PAM type: YTN; PAM sequence: TTT
ttttgagacagagtttccct

SEQ ID NO: 30812 - DNA, 20 bp, Artificial Sequence
  Description of Artificial Sequence: Synthetic oligonucleotide
  Target: FXN; (+) strand; PAM type: YTN; PAM sequence: TTT
tttgagacagagtttccctc

SEQ ID NO: 30813 - DNA, 20 bp, Artificial Sequence
  Description of Artificial Sequence: Synthetic oligonucleotide
  Target: FXN; (+) strand; PAM type: YTN; PAM sequence: TTT
ttgagacagagtttccctct

SEQ ID NO: 30814 - DNA, 20 bp, Artificial Sequence
  Description of Artificial Sequence: Synthetic oligonucleotide
  Target: FXN; (+) strand; PAM type: YTN; PAM sequence: TTT
tgagacagagtttccctctt

SEQ ID NO: 30815 - DNA, 20 bp, Artificial Sequence
  Description of Artificial Sequence: Synthetic oligonucleotide
  Target: FXN; (+) strand; PAM type: YTN; PAM sequence: TTT
gagacagagtttccctcttg

SEQ ID NO: 30816 - DNA, 20 bp, Artificial Sequence
  Description of Artificial Sequence: Synthetic oligonucleotide
  Target: FXN; (+) strand; PAM type: YTN; PAM sequence: TTG
agacagagtttccctcttgt

SEQ ID NO: 30817 - DNA, 20 bp, Artificial Sequence
  Description of Artificial Sequence: Synthetic oligonucleotide
  Target: FXN; (+) strand; PAM type: YTN; PAM sequence: TTT
ccctcttgttgcccaggctg

SEQ ID NO: 30818 - DNA, 20 bp, Artificial Sequence
  Description of Artificial Sequence: Synthetic oligonucleotide
  Target: FXN; (+) strand; PAM type: YTN; PAM sequence: TTC
cctcttgttgcccaggctgg

SEQ ID NO: 30819 - DNA, 20 bp, Artificial Sequence
  Description of Artificial Sequence: Synthetic oligonucleotide
  Target: FXN; (+) strand; PAM type: YTN; PAM sequence: CTC
ttgttgcccaggctggagtg

SEQ ID NO: 30820 - DNA, 20 bp, Artificial Sequence
  Description of Artificial Sequence: Synthetic oligonucleotide
  Target: FXN; (+) strand; PAM type: YTN; PAM sequence: CTT
gttgcccaggctggagtgca

SEQ ID NO: 30821 - DNA, 20 bp, Artificial Sequence
  Description of Artificial Sequence: Synthetic oligonucleotide
  Target: FXN; (+) strand; PAM type: YTN; PAM sequence: TTG
ttgcccaggctggagtgcag

SEQ ID NO: 30822 - DNA, 20 bp, Artificial Sequence
  Description of Artificial Sequence: Synthetic oligonucleotide
  Target: FXN; (+) strand; PAM type: YTN; PAM sequence: TTG
cccaggctggagtgcagtgg

SEQ ID NO: 30823 - DNA, 20 bp, Artificial Sequence
  Description of Artificial Sequence: Synthetic oligonucleotide
  Target: FXN; (+) strand; PAM type: YTN; PAM sequence: CTG
gagtgcagtggctcagtctc

SEQ ID NO: 30824 - DNA, 20 bp, Artificial Sequence
  Description of Artificial Sequence: Synthetic oligonucleotide
  Target: FXN; (+) strand; PAM type: YTN; PAM sequence: CTC
agtctcagctcactgcaacc

SEQ ID NO: 30825 - DNA, 20 bp, Artificial Sequence
  Description of Artificial Sequence: Synthetic oligonucleotide
  Target: FXN; (+) strand; PAM type: YTN; PAM sequence: CTC
agctcactgcaacctctgcc

SEQ ID NO: 30826 - DNA, 20 bp, Artificial Sequence
  Description of Artificial Sequence: Synthetic oligonucleotide
  Target: FXN; (+) strand; PAM type: YTN; PAM sequence: CTC
actgcaacctctgcctcctg

SEQ ID NO: 30827 - DNA, 20 bp, Artificial Sequence
  Description of Artificial Sequence: Synthetic oligonucleotide
  Target: FXN; (+) strand; PAM type: YTN; PAM sequence: CTG
caacctctgcctcctgggtt

SEQ ID NO: 30828 - DNA, 20 bp, Artificial Sequence
  Description of Artificial Sequence: Synthetic oligonucleotide
  Target: FXN; (+) strand; PAM type: YTN; PAM sequence: CTC
tgcctcctgggttcaagtga

SEQ ID NO: 30829 - DNA, 20 bp, Artificial Sequence
  Description of Artificial Sequence: Synthetic oligonucleotide
  Target: FXN; (+) strand; PAM type: YTN; PAM sequence: CTG
cctcctgggttcaagtgatt

SEQ ID NO: 30830 - DNA, 20 bp, Artificial Sequence
  Description of Artificial Sequence: Synthetic oligonucleotide
  Target: FXN; (+) strand; PAM type: YTN; PAM sequence: CTC
ctgggttcaagtgattctcc

SEQ ID NO: 30831 - DNA, 20 bp, Artificial Sequence
  Description of Artificial Sequence: Synthetic oligonucleotide
  Target: FXN; (+) strand; PAM type: YTN; PAM sequence: CTG
ggttcaagtgattctcctgc

SEQ ID NO: 30832 - DNA, 20 bp, Artificial Sequence
  Description of Artificial Sequence: Synthetic oligonucleotide
  Target: FXN; (+) strand; PAM type: YTN; PAM sequence: TTC
aagtgattctcctgcctcag

SEQ ID NO: 30833 - DNA, 20 bp, Artificial Sequence
  Description of Artificial Sequence: Synthetic oligonucleotide
  Target: FXN; (+) strand; PAM type: YTN; PAM sequence: TTC
tcctgcctcagcctcccgag

SEQ ID NO: 30834 - DNA, 20 bp, Artificial Sequence
  Description of Artificial Sequence: Synthetic oligonucleotide
  Target: FXN; (+) strand; PAM type: YTN; PAM sequence: CTC
ctgcctcagcctcccgagta

SEQ ID NO: 30835 - DNA, 20 bp, Artificial Sequence
  Description of Artificial Sequence: Synthetic oligonucleotide
  Target: FXN; (+) strand; PAM type: YTN; PAM sequence: CTG
cctcagcctcccgagtagct

SEQ ID NO: 30836 - DNA, 20 bp, Artificial Sequence
  Description of Artificial Sequence: Synthetic oligonucleotide
  Target: FXN; (+) strand; PAM type: YTN; PAM sequence: CTC
agcctcccgagtagctggga

SEQ ID NO: 30837 - DNA, 20 bp, Artificial Sequence
  Description of Artificial Sequence: Synthetic oligonucleotide
  Target: FXN; (+) strand; PAM type: YTN; PAM sequence: CTC
ccgagtagctgggattatcg

SEQ ID NO: 30838 - DNA, 20 bp, Artificial Sequence
  Description of Artificial Sequence: Synthetic oligonucleotide
  Target: FXN; (+) strand; PAM type: YTN; PAM sequence: CTG
ggattatcggctaattttgt

SEQ ID NO: 30839 - DNA, 20 bp, Artificial Sequence
  Description of Artificial Sequence: Synthetic oligonucleotide
  Target: FXN; (+) strand; PAM type: YTN; PAM sequence: TTA
tcggctaattttgtattttt

SEQ ID NO: 30840 - DNA, 20 bp, Artificial Sequence
  Description of Artificial Sequence: Synthetic oligonucleotide
  Target: FXN; (+) strand; PAM type: YTN; PAM sequence: CTA
attttgtatttttagtagag

SEQ ID NO: 30841 - DNA, 20 bp, Artificial Sequence
  Description of Artificial Sequence: Synthetic oligonucleotide
  Target: FXN; (+) strand; PAM type: YTN; PAM sequence: TTT
tgtatttttagtagagacag

SEQ ID NO: 30842 - DNA, 20 bp, Artificial Sequence
  Description of Artificial Sequence: Synthetic oligonucleotide
  Target: FXN; (+) strand; PAM type: YTN; PAM sequence: TTT
gtatttttagtagagacaga

SEQ ID NO: 30843 - DNA, 20 bp, Artificial Sequence
  Description of Artificial Sequence: Synthetic oligonucleotide
  Target: FXN; (+) strand; PAM type: YTN; PAM sequence: TTG
tatttttagtagagacagat

SEQ ID NO: 30844 - DNA, 20 bp, Artificial Sequence
  Description of Artificial Sequence: Synthetic oligonucleotide
  Target: FXN; (+) strand; PAM type: YTN; PAM sequence: TTT
ttagtagagacagatttctc

SEQ ID NO: 30845 - DNA, 20 bp, Artificial Sequence
  Description of Artificial Sequence: Synthetic oligonucleotide
  Target: FXN; (+) strand; PAM type: YTN; PAM sequence: TTT
tagtagagacagatttctcc

SEQ ID NO: 30846 - DNA, 20 bp, Artificial Sequence
  Description of Artificial Sequence: Synthetic oligonucleotide
  Target: FXN; (+) strand; PAM type: YTN; PAM sequence: TTT
agtagagacagatttctcca

SEQ ID NO: 30847 - DNA, 20 bp, Artificial Sequence
  Description of Artificial Sequence: Synthetic oligonucleotide
  Target: FXN; (+) strand; PAM type: YTN; PAM sequence: TTA
gtagagacagatttctccat

SEQ ID NO: 30848 - DNA, 20 bp, Artificial Sequence
  Description of Artificial Sequence: Synthetic oligonucleotide
  Target: FXN; (+) strand; PAM type: YTN; PAM sequence: TTT
ctccatgttggtcaggctgg

SEQ ID NO: 30849 - DNA, 20 bp, Artificial Sequence
  Description of Artificial Sequence: Synthetic oligonucleotide
  Target: FXN; (+) strand; PAM type: YTN; PAM sequence: TTC
tccatgttggtcaggctggt

SEQ ID NO: 30850 - DNA, 20 bp, Artificial Sequence
  Description of Artificial Sequence: Synthetic oligonucleotide
  Target: FXN; (+) strand; PAM type: YTN; PAM sequence: CTC
catgttggtcaggctggtct

SEQ ID NO: 30851 - DNA, 20 bp, Artificial Sequence
  Description of Artificial Sequence: Synthetic oligonucleotide
  Target: FXN; (+) strand; PAM type: YTN; PAM sequence: TTG
gtcaggctggtctcgaactc

SEQ ID NO: 30852 - DNA, 20 bp, Artificial Sequence
  Description of Artificial Sequence: Synthetic oligonucleotide
  Target: FXN; (+) strand; PAM type: YTN; PAM sequence: CTG
gtctcgaactcccaacctca

SEQ ID NO: 30853 - DNA, 20 bp, Artificial Sequence
  Description of Artificial Sequence: Synthetic oligonucleotide
  Target: FXN; (+) strand; PAM type: YTN; PAM sequence: CTC
gaactcccaacctcaggtga

SEQ ID NO: 30854 - DNA, 20 bp, Artificial Sequence
  Description of Artificial Sequence: Synthetic oligonucleotide
  Target: FXN; (+) strand; PAM type: YTN; PAM sequence: CTC
ccaacctcaggtgatccgcc

SEQ ID NO: 30855 - DNA, 20 bp, Artificial Sequence
  Description of Artificial Sequence: Synthetic oligonucleotide
  Target: FXN; (+) strand; PAM type: YTN; PAM sequence: CTC
aggtgatccgcccacctcgc

SEQ ID NO: 30856 - DNA, 20 bp, Artificial Sequence
  Description of Artificial Sequence: Synthetic oligonucleotide
  Target: FXN; (+) strand; PAM type: YTN; PAM sequence: CTC
gccctcccaaagtgctggaa

SEQ ID NO: 30857 - DNA, 20 bp, Artificial Sequence
  Description of Artificial Sequence: Synthetic oligonucleotide
  Target: FXN; (+) strand; PAM type: YTN; PAM sequence: CTC
ccaaagtgctggaattacag

SEQ ID NO: 30858 - DNA, 20 bp, Artificial Sequence
  Description of Artificial Sequence: Synthetic oligonucleotide
  Target: FXN; (+) strand; PAM type: YTN; PAM sequence: CTG
gaattacaggcgtgagccac

SEQ ID NO: 30859 - DNA, 20 bp, Artificial Sequence
  Description of Artificial Sequence: Synthetic oligonucleotide
  Target: FXN; (+) strand; PAM type: YTN; PAM sequence: TTA
caggcgtgagccaccgcgtc

SEQ ID NO: 30860 - DNA, 20 bp, Artificial Sequence
  Description of Artificial Sequence: Synthetic oligonucleotide
  Target: FXN; (+) strand; PAM type: YTN; PAM sequence: CTG
gccatcagcagagtttttaa

SEQ ID NO: 30861 - DNA, 20 bp, Artificial Sequence
  Description of Artificial Sequence: Synthetic oligonucleotide
  Target: FXN; (+) strand; PAM type: YTN; PAM sequence: TTT
ttaatttaggagaatgacaa

SEQ ID NO: 30862 - DNA, 20 bp, Artificial Sequence
  Description of Artificial Sequence: Synthetic oligonucleotide
  Target: FXN; (+) strand; PAM type: YTN; PAM sequence: TTT
taatttaggagaatgacaag

SEQ ID NO: 30863 - DNA, 20 bp, Artificial Sequence
  Description of Artificial Sequence: Synthetic oligonucleotide
  Target: FXN; (+) strand; PAM type: YTN; PAM sequence: TTT
aatttaggagaatgacaaga

SEQ ID NO: 30864 - DNA, 20 bp, Artificial Sequence
  Description of Artificial Sequence: Synthetic oligonucleotide
  Target: FXN; (+) strand; PAM type: YTN; PAM sequence: TTA
atttaggagaatgacaagag

SEQ ID NO: 30865 - DNA, 20 bp, Artificial Sequence
  Description of Artificial Sequence: Synthetic oligonucleotide
  Target: FXN; (+) strand; PAM type: YTN; PAM sequence: TTT
aggagaatgacaagaggtgg

SEQ ID NO: 30866 - DNA, 20 bp, Artificial Sequence
  Description of Artificial Sequence: Synthetic oligonucleotide
  Target: FXN; (+) strand; PAM type: YTN; PAM sequence: TTA
ggagaatgacaagaggtggt

SEQ ID NO: 30867 - DNA, 20 bp, Artificial Sequence
  Description of Artificial Sequence: Synthetic oligonucleotide
  Target: FXN; (+) strand; PAM type: YTN; PAM sequence: TTT
tttagatggtacctggtggc

SEQ ID NO: 30868 - DNA, 20 bp, Artificial Sequence
  Description of Artificial Sequence: Synthetic oligonucleotide
  Target: FXN; (+) strand; PAM type: YTN; PAM sequence: TTT
ttagatggtacctggtggct

SEQ ID NO: 30869 - DNA, 20 bp, Artificial Sequence
  Description of Artificial Sequence: Synthetic oligonucleotide
  Target: FXN; (+) strand; PAM type: YTN; PAM sequence: TTT
tagatggtacctggtggctg

SEQ ID NO: 30870 - DNA, 20 bp, Artificial Sequence
  Description of Artificial Sequence: Synthetic oligonucleotide
  Target: FXN; (+) strand; PAM type: YTN; PAM sequence: TTT
agatggtacctggtggctgt

SEQ ID NO: 30871 - DNA, 20 bp, Artificial Sequence
  Description of Artificial Sequence: Synthetic oligonucleotide
  Target: FXN; (+) strand; PAM type: YTN; PAM sequence: TTA
gatggtacctggtggctgtt

SEQ ID NO: 30872 - DNA, 20 bp, Artificial Sequence
  Description of Artificial Sequence: Synthetic oligonucleotide
  Target: FXN; (+) strand; PAM type: YTN; PAM sequence: CTG
gtggctgttaagggctattg

SEQ ID NO: 30873 - DNA, 20 bp, Artificial Sequence
  Description of Artificial Sequence: Synthetic oligonucleotide
  Target: FXN; (+) strand; PAM type: YTN; PAM sequence: CTG
ttaagggctattgactgaca

SEQ ID NO: 30874 - DNA, 20 bp, Artificial Sequence
  Description of Artificial Sequence: Synthetic oligonucleotide
  Target: FXN; (+) strand; PAM type: YTN; PAM sequence: TTA
agggctattgactgacaaac

SEQ ID NO: 30875 - DNA, 20 bp, Artificial Sequence
  Description of Artificial Sequence: Synthetic oligonucleotide
  Target: FXN; (+) strand; PAM type: YTN; PAM sequence: CTA
ttgactgacaaacacaccca

SEQ ID NO: 30876 - DNA, 20 bp, Artificial Sequence
  Description of Artificial Sequence: Synthetic oligonucleotide
  Target: FXN; (+) strand; PAM type: YTN; PAM sequence: TTG
actgacaaacacacccaact

SEQ ID NO: 30877 - DNA, 20 bp, Artificial Sequence
  Description of Artificial Sequence: Synthetic oligonucleotide
  Target: FXN; (+) strand; PAM type: YTN; PAM sequence: CTG
acaaacacacccaacttggc

SEQ ID NO: 30878 - DNA, 20 bp, Artificial Sequence
  Description of Artificial Sequence: Synthetic oligonucleotide
  Target: FXN; (+) strand; PAM type: YTN; PAM sequence: CTT
ggcgctgccgcccaggaggt

SEQ ID NO: 30879 - DNA, 20 bp, Artificial Sequence
  Description of Artificial Sequence: Synthetic oligonucleotide
  Target: FXN; (+) strand; PAM type: YTN; PAM sequence: TTG
gcgctgccgcccaggaggtg

SEQ ID NO: 30880 - DNA, 20 bp, Artificial Sequence
  Description of Artificial Sequence: Synthetic oligonucleotide
  Target: FXN; (+) strand; PAM type: YTN; PAM sequence: CTG
ccgcccaggaggtggacact

SEQ ID NO: 30881 - DNA, 20 bp, Artificial Sequence
  Description of Artificial Sequence: Synthetic oligonucleotide
  Target: FXN; (+) strand; PAM type: YTN; PAM sequence: CTG
ggtttctggatagatggtta

SEQ ID NO: 30882 - DNA, 20 bp, Artificial Sequence
  Description of Artificial Sequence: Synthetic oligonucleotide
  Target: FXN; (+) strand; PAM type: YTN; PAM sequence: TTT
ctggatagatggttagcaac

SEQ ID NO: 30883 - DNA, 20 bp, Artificial Sequence
  Description of Artificial Sequence: Synthetic oligonucleotide
  Target: FXN; (+) strand; PAM type: YTN; PAM sequence: TTC
tggatagatggttagcaacc

SEQ ID NO: 30884 - DNA, 20 bp, Artificial Sequence
  Description of Artificial Sequence: Synthetic oligonucleotide
  Target: FXN; (+) strand; PAM type: YTN; PAM sequence: CTG
gatagatggttagcaacctc

SEQ ID NO: 30885 - DNA, 20 bp, Artificial Sequence
  Description of Artificial Sequence: Synthetic oligonucleotide
  Target: FXN; (+) strand; PAM type: YTN; PAM sequence: TTA
gcaacctctgtcaccagctg

SEQ ID NO: 30886 - DNA, 20 bp, Artificial Sequence
  Description of Artificial Sequence: Synthetic oligonucleotide
  Target: FXN; (+) strand; PAM type: YTN; PAM sequence: CTC
tgtcaccagctgggcctctt

SEQ ID NO: 30887 - DNA, 20 bp, Artificial Sequence
  Description of Artificial Sequence: Synthetic oligonucleotide
  Target: FXN; (+) strand; PAM type: YTN; PAM sequence: CTG
tcaccagctgggcctctttt

SEQ ID NO: 30888 - DNA, 20 bp, Artificial Sequence
  Description of Artificial Sequence: Synthetic oligonucleotide
  Target: FXN; (+) strand; PAM type: YTN; PAM sequence: CTG
ggcctctttttttctatact

SEQ ID NO: 30889 - DNA, 20 bp, Artificial Sequence
  Description of Artificial Sequence: Synthetic oligonucleotide
  Target: FXN; (+) strand; PAM type: YTN; PAM sequence: CTC
tttttttctatactgaatta

SEQ ID NO: 30890 - DNA, 20 bp, Artificial Sequence
  Description of Artificial Sequence: Synthetic oligonucleotide
  Target: FXN; (+) strand; PAM type: YTN; PAM sequence: CTT
tttttctatactgaattaat

SEQ ID NO: 30891 - DNA, 20 bp, Artificial Sequence
  Description of Artificial Sequence: Synthetic oligonucleotide
  Target: FXN; (+) strand; PAM type: YTN; PAM sequence: TTT
ttttctatactgaattaatc

SEQ ID NO: 30892 - DNA, 20 bp, Artificial Sequence
  Description of Artificial Sequence: Synthetic oligonucleotide
  Target: FXN; (+) strand; PAM type: YTN; PAM sequence: TTT
tttctatactgaattaatca

SEQ ID NO: 30893 - DNA, 20 bp, Artificial Sequence
  Description of Artificial Sequence: Synthetic oligonucleotide
  Target: FXN; (+) strand; PAM type: YTN; PAM sequence: TTT
ttctatactgaattaatcac

SEQ ID NO: 30894 - DNA, 20 bp, Artificial Sequence
  Description of Artificial Sequence: Synthetic oligonucleotide
  Target: FXN; (+) strand; PAM type: YTN; PAM sequence: TTT
tctatactgaattaatcaca

SEQ ID NO: 30895 - DNA, 20 bp, Artificial Sequence
  Description of Artificial Sequence: Synthetic oligonucleotide
  Target: FXN; (+) strand; PAM type: YTN; PAM sequence: TTT
ctatactgaattaatcacat

SEQ ID NO: 30896 - DNA, 20 bp, Artificial Sequence
  Description of Artificial Sequence: Synthetic oligonucleotide
  Target: FXN; (+) strand; PAM type: YTN; PAM sequence: TTC
tatactgaattaatcacatt

SEQ ID NO: 30897 - DNA, 20 bp, Artificial Sequence
  Description of Artificial Sequence: Synthetic oligonucleotide
  Target: FXN; (+) strand; PAM type: YTN; PAM sequence: CTA
tactgaattaatcacatttg

SEQ ID NO: 30898 - DNA, 20 bp, Artificial Sequence
  Description of Artificial Sequence: Synthetic oligonucleotide
  Target: FXN; (+) strand; PAM type: YTN; PAM sequence: CTG
aattaatcacatttgtttaa

SEQ ID NO: 30899 - DNA, 20 bp, Artificial Sequence
  Description of Artificial Sequence: Synthetic oligonucleotide
  Target: FXN; (+) strand; PAM type: YTN; PAM sequence: TTA
atcacatttgtttaacctgt

SEQ ID NO: 30900 - DNA, 20 bp, Artificial Sequence
  Description of Artificial Sequence: Synthetic oligonucleotide
  Target: FXN; (+) strand; PAM type: YTN; PAM sequence: TTT
gtttaacctgtctgttccat

SEQ ID NO: 30901 - DNA, 20 bp, Artificial Sequence
  Description of Artificial Sequence: Synthetic oligonucleotide
  Target: FXN; (+) strand; PAM type: YTN; PAM sequence: TTG
tttaacctgtctgttccata

SEQ ID NO: 30902 - DNA, 20 bp, Artificial Sequence
  Description of Artificial Sequence: Synthetic oligonucleotide
  Target: FXN; (+) strand; PAM type: YTN; PAM sequence: TTT
aacctgtctgttccatagtt

SEQ ID NO: 30903 - DNA, 20 bp, Artificial Sequence
  Description of Artificial Sequence: Synthetic oligonucleotide
  Target: FXN; (+) strand; PAM type: YTN; PAM sequence: TTA
acctgtctgttccatagttc

SEQ ID NO: 30904 - DNA, 20 bp, Artificial Sequence
  Description of Artificial Sequence: Synthetic oligonucleotide
  Target: FXN; (+) strand; PAM type: YTN; PAM sequence: CTG
tctgttccatagttcccttg

SEQ ID NO: 30905 - DNA, 20 bp, Artificial Sequence
  Description of Artificial Sequence: Synthetic oligonucleotide
  Target: FXN; (+) strand; PAM type: YTN; PAM sequence: CTG
ttccatagttcccttgcaca

SEQ ID NO: 30906 - DNA, 20 bp, Artificial Sequence
  Description of Artificial Sequence: Synthetic oligonucleotide
  Target: FXN; (+) strand; PAM type: YTN; PAM sequence: TTC
catagttcccttgcacatct

SEQ ID NO: 30907 - DNA, 20 bp, Artificial Sequence
  Description of Artificial Sequence: Synthetic oligonucleotide
  Target: FXN; (+) strand; PAM type: YTN; PAM sequence: TTC
ccttgcacatcttgggtatt

SEQ ID NO: 30908 - DNA, 20 bp, Artificial Sequence
  Description of Artificial Sequence: Synthetic oligonucleotide
  Target: FXN; (+) strand; PAM type: YTN; PAM sequence: CTT
gcacatcttgggtatttgag

SEQ ID NO: 30909 - DNA, 20 bp, Artificial Sequence
  Description of Artificial Sequence: Synthetic oligonucleotide
  Target: FXN; (+) strand; PAM type: YTN; PAM sequence: TTG
cacatcttgggtatttgagg

SEQ ID NO: 30910 - DNA, 20 bp, Artificial Sequence
  Description of Artificial Sequence: Synthetic oligonucleotide
  Target: FXN; (+) strand; PAM type: YTN; PAM sequence: CTT
gggtatttgaggagttgggt

SEQ ID NO: 30911 - DNA, 20 bp, Artificial Sequence
  Description of Artificial Sequence: Synthetic oligonucleotide
  Target: FXN; (+) strand; PAM type: YTN; PAM sequence: TTG
ggtatttgaggagttgggtg

SEQ ID NO: 30912 - DNA, 20 bp, Artificial Sequence
  Description of Artificial Sequence: Synthetic oligonucleotide
  Target: FXN; (+) strand; PAM type: YTN; PAM sequence: TTT
gaggagttgggtgggtggca

SEQ ID NO: 30913 - DNA, 20 bp, Artificial Sequence
  Description of Artificial Sequence: Synthetic oligonucleotide
  Target: FXN; (+) strand; PAM type: YTN; PAM sequence: TTG
aggagttgggtgggtggcag

SEQ ID NO: 30914 - DNA, 20 bp, Artificial Sequence
  Description of Artificial Sequence: Synthetic oligonucleotide
  Target: FXN; (+) strand; PAM type: YTN; PAM sequence: TTG
ggtgggtggcagtggcaact

SEQ ID NO: 30915 - DNA, 20 bp, Artificial Sequence
  Description of Artificial Sequence: Synthetic oligonucleotide
  Target: FXN; (+) strand; PAM type: YTN; PAM sequence: CTG
gggccaccatcctgtttaat

SEQ ID NO: 30916 - DNA, 20 bp, Artificial Sequence
  Description of Artificial Sequence: Synthetic oligonucleotide
  Target: FXN; (+) strand; PAM type: YTN; PAM sequence: CTG
tttaattattttaaagccct

SEQ ID NO: 30917 - DNA, 20 bp, Artificial Sequence
  Description of Artificial Sequence: Synthetic oligonucleotide
  Target: FXN; (+) strand; PAM type: YTN; PAM sequence: TTT
aattattttaaagccctgac

SEQ ID NO: 30918 - DNA, 20 bp, Artificial Sequence
  Description of Artificial Sequence: Synthetic oligonucleotide
  Target: FXN; (+) strand; PAM type: YTN; PAM sequence: TTA
attattttaaagccctgact

SEQ ID NO: 30919 - DNA, 20 bp, Artificial Sequence
  Description of Artificial Sequence: Synthetic oligonucleotide
  Target: FXN; (+) strand; PAM type: YTN; PAM sequence: TTA
ttttaaagccctgactgtcc

SEQ ID NO: 30920 - DNA, 20 bp, Artificial Sequence
  Description of Artificial Sequence: Synthetic oligonucleotide
  Target: FXN; (+) strand; PAM type: YTN; PAM sequence: TTT
taaagccctgactgtcctgg

SEQ ID NO: 30921 - DNA, 20 bp, Artificial Sequence
  Description of Artificial Sequence: Synthetic oligonucleotide
  Target: FXN; (+) strand; PAM type: YTN; PAM sequence: TTT
aaagccctgactgtcctgga

SEQ ID NO: 30922 - DNA, 20 bp, Artificial Sequence
  Description of Artificial Sequence: Synthetic oligonucleotide
  Target: FXN; (+) strand; PAM type: YTN; PAM sequence: TTA
aagccctgactgtcctggat

SEQ ID NO: 30923 - DNA, 20 bp, Artificial Sequence
  Description of Artificial Sequence: Synthetic oligonucleotide
  Target: FXN; (+) strand; PAM type: YTN; PAM sequence: CTG
actgtcctggattgacccta

SEQ ID NO: 30924 - DNA, 20 bp, Artificial Sequence
  Description of Artificial Sequence: Synthetic oligonucleotide
  Target: FXN; (+) strand; PAM type: YTN; PAM sequence: CTG
tcctggattgaccctaagct

SEQ ID NO: 30925 - DNA, 20 bp, Artificial Sequence
  Description of Artificial Sequence: Synthetic oligonucleotide
  Target: FXN; (+) strand; PAM type: YTN; PAM sequence: CTG
gattgaccctaagctccccc

SEQ ID NO: 30926 - DNA, 20 bp, Artificial Sequence
  Description of Artificial Sequence: Synthetic oligonucleotide
  Target: FXN; (+) strand; PAM type: YTN; PAM sequence: TTG
accctaagctccccctggtc

SEQ ID NO: 30927 - DNA, 20 bp, Artificial Sequence
  Description of Artificial Sequence: Synthetic oligonucleotide
  Target: FXN; (+) strand; PAM type: YTN; PAM sequence: CTA
agctccccctggtctccaaa

SEQ ID NO: 30928 - DNA, 20 bp, Artificial Sequence
  Description of Artificial Sequence: Synthetic oligonucleotide
  Target: FXN; (+) strand; PAM type: YTN; PAM sequence: CTC
cccctggtctccaaaattca

SEQ ID NO: 30929 - DNA, 20 bp, Artificial Sequence
  Description of Artificial Sequence: Synthetic oligonucleotide
  Target: FXN; (+) strand; PAM type: YTN; PAM sequence: CTG
gtctccaaaattcatcagaa

SEQ ID NO: 30930 - DNA, 20 bp, Artificial Sequence
  Description of Artificial Sequence: Synthetic oligonucleotide
  Target: FXN; (+) strand; PAM type: YTN; PAM sequence: CTC
caaaattcatcagaaactga

SEQ ID NO: 30931 - DNA, 20 bp, Artificial Sequence
  Description of Artificial Sequence: Synthetic oligonucleotide
  Target: FXN; (+) strand; PAM type: YTN; PAM sequence: TTC
atcagaaactgagttcactt

SEQ ID NO: 30932 - DNA, 20 bp, Artificial Sequence
  Description of Artificial Sequence: Synthetic oligonucleotide
  Target: FXN; (+) strand; PAM type: YTN; PAM sequence: CTG
agttcacttgaaggcctctt

SEQ ID NO: 30933 - DNA, 20 bp, Artificial Sequence
  Description of Artificial Sequence: Synthetic oligonucleotide
  Target: FXN; (+) strand; PAM type: YTN; PAM sequence: TTC
acttgaaggcctcttcccca

SEQ ID NO: 30934 - DNA, 20 bp, Artificial Sequence
  Description of Artificial Sequence: Synthetic oligonucleotide
  Target: FXN; (+) strand; PAM type: YTN; PAM sequence: CTT
gaaggcctcttccccaccct

SEQ ID NO: 30935 - DNA, 20 bp, Artificial Sequence
  Description of Artificial Sequence: Synthetic oligonucleotide
  Target: FXN; (+) strand; PAM type: YTN; PAM sequence: TTG
aaggcctcttccccaccctt

SEQ ID NO: 30936 - DNA, 20 bp, Artificial Sequence
  Description of Artificial Sequence: Synthetic oligonucleotide
  Target: FXN; (+) strand; PAM type: YTN; PAM sequence: CTC
ttccccacccttttctccac

SEQ ID NO: 30937 - DNA, 20 bp, Artificial Sequence
  Description of Artificial Sequence: Synthetic oligonucleotide
  Target: FXN; (+) strand; PAM type: YTN; PAM sequence: CTT
ccccacccttttctccaccc

SEQ ID NO: 30938 - DNA, 20 bp, Artificial Sequence
  Description of Artificial Sequence: Synthetic oligonucleotide
  Target: FXN; (+) strand; PAM type: YTN; PAM sequence: TTC
cccacccttttctccacccc

SEQ ID NO: 30939 - DNA, 20 bp, Artificial Sequence
  Description of Artificial Sequence: Synthetic oligonucleotide
  Target: FXN; (+) strand; PAM type: YTN; PAM sequence: CTT
ttctccaccccttgcatcta

SEQ ID NO: 30940 - DNA, 20 bp, Artificial Sequence
  Description of Artificial Sequence: Synthetic oligonucleotide
  Target: FXN; (+) strand; PAM type: YTN; PAM sequence: TTT
tctccaccccttgcatctac

SEQ ID NO: 30941 - DNA, 20 bp, Artificial Sequence
  Description of Artificial Sequence: Synthetic oligonucleotide
  Target: FXN; (+) strand; PAM type: YTN; PAM sequence: TTT
ctccaccccttgcatctact

SEQ ID NO: 30942 - DNA, 20 bp, Artificial Sequence
  Description of Artificial Sequence: Synthetic oligonucleotide
  Target: FXN; (+) strand; PAM type: YTN; PAM sequence: TTC
tccaccccttgcatctactt

SEQ ID NO: 30943 - DNA, 20 bp, Artificial Sequence
  Description of Artificial Sequence: Synthetic oligonucleotide
  Target: FXN; (+) strand; PAM type: YTN; PAM sequence: CTC
caccccttgcatctacttct

SEQ ID NO: 30944 - DNA, 20 bp, Artificial Sequence
  Description of Artificial Sequence: Synthetic oligonucleotide
  Target: FXN; (+) strand; PAM type: YTN; PAM sequence: CTT
gcatctacttctaaagcagc

SEQ ID NO: 30945 - DNA, 20 bp, Artificial Sequence
  Description of Artificial Sequence: Synthetic oligonucleotide
  Target: FXN; (+) strand; PAM type: YTN; PAM sequence: TTG
catctacttctaaagcagct

SEQ ID NO: 30946 - DNA, 20 bp, Artificial Sequence
  Description of Artificial Sequence: Synthetic oligonucleotide
  Target: FXN; (+) strand; PAM type: YTN; PAM sequence: CTA
cttctaaagcagctgttcaa

SEQ ID NO: 30947 - DNA, 20 bp, Artificial Sequence
  Description of Artificial Sequence: Synthetic oligonucleotide
  Target: FXN; (+) strand; PAM type: YTN; PAM sequence: CTT
ctaaagcagctgttcaacag

SEQ ID NO: 30948 - DNA, 20 bp, Artificial Sequence
  Description of Artificial Sequence: Synthetic oligonucleotide
  Target: FXN; (+) strand; PAM type: YTN; PAM sequence: TTC
taaagcagctgttcaacaga

SEQ ID NO: 30949 - DNA, 20 bp, Artificial Sequence
  Description of Artificial Sequence: Synthetic oligonucleotide
  Target: FXN; (+) strand; PAM type: YTN; PAM sequence: CTA
aagcagctgttcaacagaaa

SEQ ID NO: 30950 - DNA, 20 bp, Artificial Sequence
  Description of Artificial Sequence: Synthetic oligonucleotide
  Target: FXN; (+) strand; PAM type: YTN; PAM sequence: CTG
ttcaacagaaacagaatggg

SEQ ID NO: 30951 - DNA, 20 bp, Artificial Sequence
  Description of Artificial Sequence: Synthetic oligonucleotide
  Target: FXN; (+) strand; PAM type: YTN; PAM sequence: TTC
aacagaaacagaatgggagc

SEQ ID NO: 30952 - DNA, 20 bp, Artificial Sequence
  Description of Artificial Sequence: Synthetic oligonucleotide
  Target: FXN; (+) strand; PAM type: YTN; PAM sequence: TTC
tacattttctagttaaaaag

SEQ ID NO: 30953 - DNA, 20 bp, Artificial Sequence
  Description of Artificial Sequence: Synthetic oligonucleotide
  Target: FXN; (+) strand; PAM type: YTN; PAM sequence: CTA
cattttctagttaaaaagaa

SEQ ID NO: 30954 - DNA, 20 bp, Artificial Sequence
  Description of Artificial Sequence: Synthetic oligonucleotide
  Target: FXN; (+) strand; PAM type: YTN; PAM sequence: TTT
tctagttaaaaagaaaaaaa

SEQ ID NO: 30955 - DNA, 20 bp, Artificial Sequence
  Description of Artificial Sequence: Synthetic oligonucleotide
  Target: FXN; (+) strand; PAM type: YTN; PAM sequence: TTT
ctagttaaaaagaaaaaaaa

SEQ ID NO: 30956 - DNA, 20 bp, Artificial Sequence
  Description of Artificial Sequence: Synthetic oligonucleotide
  Target: FXN; (+) strand; PAM type: YTN; PAM sequence: TTC
tagttaaaaagaaaaaaaaa

SEQ ID NO: 30957 - DNA, 20 bp, Artificial Sequence
  Description of Artificial Sequence: Synthetic oligonucleotide
  Target: FXN; (+) strand; PAM type: YTN; PAM sequence: CTA
gttaaaaagaaaaaaaaatc

SEQ ID NO: 30958 - DNA, 20 bp, Artificial Sequence
  Description of Artificial Sequence: Synthetic oligonucleotide
  Target: FXN; (+) strand; PAM type: YTN; PAM sequence: TTA
aaaagaaaaaaaaatcattt

SEQ ID NO: 30959 - DNA, 20 bp, Artificial Sequence
  Description of Artificial Sequence: Synthetic oligonucleotide
  Target: FXN; (+) strand; PAM type: YTN; PAM sequence: TTT
tcaacaatatatttattcaa

SEQ ID NO: 30960 - DNA, 20 bp, Artificial Sequence
  Description of Artificial Sequence: Synthetic oligonucleotide
  Target: FXN; (+) strand; PAM type: YTN; PAM sequence: TTT
caacaatatatttattcaac

SEQ ID NO: 30961 - DNA, 20 bp, Artificial Sequence
  Description of Artificial Sequence: Synthetic oligonucleotide
  Target: FXN; (+) strand; PAM type: YTN; PAM sequence: TTC
aacaatatatttattcaacc

SEQ ID NO: 30962 - DNA, 20 bp, Artificial Sequence
  Description of Artificial Sequence: Synthetic oligonucleotide
  Target: FXN; (+) strand; PAM type: YTN; PAM sequence: TTT
attcaacctagtacatacaa

SEQ ID NO: 30963 - DNA, 20 bp, Artificial Sequence
  Description of Artificial Sequence: Synthetic oligonucleotide
  Target: FXN; (+) strand; PAM type: YTN; PAM sequence: TTA
ttcaacctagtacatacaaa

SEQ ID NO: 30964 - DNA, 20 bp, Artificial Sequence
  Description of Artificial Sequence: Synthetic oligonucleotide
  Target: FXN; (+) strand; PAM type: YTN; PAM sequence: TTC
aacctagtacatacaaaata

SEQ ID NO: 30965 - DNA, 20 bp, Artificial Sequence
  Description of Artificial Sequence: Synthetic oligonucleotide
  Target: FXN; (+) strand; PAM type: YTN; PAM sequence: CTA
gtacatacaaaatattatca

SEQ ID NO: 30966 - DNA, 20 bp, Artificial Sequence
  Description of Artificial Sequence: Synthetic oligonucleotide
  Target: FXN; (+) strand; PAM type: YTN; PAM sequence: TTA
tcattccaacatgtaatcag

SEQ ID NO: 30967 - DNA, 20 bp, Artificial Sequence
  Description of Artificial Sequence: Synthetic oligonucleotide
  Target: FXN; (+) strand; PAM type: YTN; PAM sequence: TTC
caacatgtaatcagtatttt

SEQ ID NO: 30968 - DNA, 20 bp, Artificial Sequence
  Description of Artificial Sequence: Synthetic oligonucleotide
  Target: FXN; (+) strand; PAM type: YTN; PAM sequence: TTT
taaaaatcagtaatgagacc

SEQ ID NO: 30969 - DNA, 20 bp, Artificial Sequence
  Description of Artificial Sequence: Synthetic oligonucleotide
  Target: FXN; (+) strand; PAM type: YTN; PAM sequence: TTT
aaaaatcagtaatgagacca

SEQ ID NO: 30970 - DNA, 20 bp, Artificial Sequence
  Description of Artificial Sequence: Synthetic oligonucleotide
  Target: FXN; (+) strand; PAM type: YTN; PAM sequence: TTA
aaaatcagtaatgagaccag

SEQ ID NO: 30971 - DNA, 20 bp, Artificial Sequence
  Description of Artificial Sequence: Synthetic oligonucleotide
  Target: FXN; (+) strand; PAM type: YTN; PAM sequence: CTC
acgactgtaatcccaggact

SEQ ID NO: 30972 - DNA, 20 bp, Artificial Sequence
  Description of Artificial Sequence: Synthetic oligonucleotide
  Target: FXN; (+) strand; PAM type: YTN; PAM sequence: CTG
taatcccaggactttgggag

SEQ ID NO: 30973 - DNA, 20 bp, Artificial Sequence
  Description of Artificial Sequence: Synthetic oligonucleotide
  Target: FXN; (+) strand; PAM type: YTN; PAM sequence: CTT
tgggaggccgaggcgagtgg

SEQ ID NO: 30974 - DNA, 20 bp, Artificial Sequence
  Description of Artificial Sequence: Synthetic oligonucleotide
  Target: FXN; (+) strand; PAM type: YTN; PAM sequence: TTT
gggaggccgaggcgagtgga

SEQ ID NO: 30975 - DNA, 20 bp, Artificial Sequence
  Description of Artificial Sequence: Synthetic oligonucleotide
  Target: FXN; (+) strand; PAM type: YTN; PAM sequence: TTG
ggaggccgaggcgagtggat

SEQ ID NO: 30976 - DNA, 20 bp, Artificial Sequence
  Description of Artificial Sequence: Synthetic oligonucleotide
  Target: FXN; (+) strand; PAM type: YTN; PAM sequence: CTG
agatcaggagttcaagacca

SEQ ID NO: 30977 - DNA, 20 bp, Artificial Sequence
  Description of Artificial Sequence: Synthetic oligonucleotide
  Target: FXN; (+) strand; PAM type: YTN; PAM sequence: TTC
aagaccagcctggccaacat

SEQ ID NO: 30978 - DNA, 20 bp, Artificial Sequence
  Description of Artificial Sequence: Synthetic oligonucleotide
  Target: FXN; (+) strand; PAM type: YTN; PAM sequence: CTG
gccaacatggtgaaacccca

SEQ ID NO: 30979 - DNA, 20 bp, Artificial Sequence
  Description of Artificial Sequence: Synthetic oligonucleotide
  Target: FXN; (+) strand; PAM type: YTN; PAM sequence: CTC
tactaaaaactagctcagca

SEQ ID NO: 30980 - DNA, 20 bp, Artificial Sequence
  Description of Artificial Sequence: Synthetic oligonucleotide
  Target: FXN; (+) strand; PAM type: YTN; PAM sequence: CTA
ctaaaaactagctcagcatg

SEQ ID NO: 30981 - DNA, 20 bp, Artificial Sequence
  Description of Artificial Sequence: Synthetic oligonucleotide
  Target: FXN; (+) strand; PAM type: YTN; PAM sequence: CTA
aaaactagctcagcatggtg

SEQ ID NO: 30982 - DNA, 20 bp, Artificial Sequence
  Description of Artificial Sequence: Synthetic oligonucleotide
  Target: FXN; (+) strand; PAM type: YTN; PAM sequence: CTA
gctcagcatggtggtgggtg

SEQ ID NO: 30983 - DNA, 20 bp, Artificial Sequence
  Description of Artificial Sequence: Synthetic oligonucleotide
  Target: FXN; (+) strand; PAM type: YTN; PAM sequence: CTC
agcatggtggtgggtgcctg

SEQ ID NO: 30984 - DNA, 20 bp, Artificial Sequence
  Description of Artificial Sequence: Synthetic oligonucleotide
  Target: FXN; (+) strand; PAM type: YTN; PAM sequence: CTG
tagtcccagctactcgggag

SEQ ID NO: 30985 - DNA, 20 bp, Artificial Sequence
  Description of Artificial Sequence: Synthetic oligonucleotide
  Target: FXN; (+) strand; PAM type: YTN; PAM sequence: CTA
ctcgggaggctgaggcatga

SEQ ID NO: 30986 - DNA, 20 bp, Artificial Sequence
  Description of Artificial Sequence: Synthetic oligonucleotide
  Target: FXN; (+) strand; PAM type: YTN; PAM sequence: CTC
gggaggctgaggcatgagaa

SEQ ID NO: 30987 - DNA, 20 bp, Artificial Sequence
  Description of Artificial Sequence: Synthetic oligonucleotide
  Target: FXN; (+) strand; PAM type: YTN; PAM sequence: CTG
aggcatgagaatcacttgag

SEQ ID NO: 30988 - DNA, 20 bp, Artificial Sequence
  Description of Artificial Sequence: Synthetic oligonucleotide
  Target: FXN; (+) strand; PAM type: YTN; PAM sequence: CTT
gagcccaggaggcagaggtt

SEQ ID NO: 30989 - DNA, 20 bp, Artificial Sequence
  Description of Artificial Sequence: Synthetic oligonucleotide
  Target: FXN; (+) strand; PAM type: YTN; PAM sequence: TTG
agcccaggaggcagaggttg

SEQ ID NO: 30990 - DNA, 20 bp, Artificial Sequence
  Description of Artificial Sequence: Synthetic oligonucleotide
  Target: FXN; (+) strand; PAM type: YTN; PAM sequence: TTG
cagtgagccaagattttggg

SEQ ID NO: 30991 - DNA, 20 bp, Artificial Sequence
  Description of Artificial Sequence: Synthetic oligonucleotide
  Target: FXN; (+) strand; PAM type: YTN; PAM sequence: TTT
tgggggattctgtgacatac

SEQ ID NO: 30992 - DNA, 20 bp, Artificial Sequence
  Description of Artificial Sequence: Synthetic oligonucleotide
  Target: FXN; (+) strand; PAM type: YTN; PAM sequence: TTT
gggggattctgtgacataca

SEQ ID NO: 30993 - DNA, 20 bp, Artificial Sequence
  Description of Artificial Sequence: Synthetic oligonucleotide
  Target: FXN; (+) strand; PAM type: YTN; PAM sequence: TTG
ggggattctgtgacatacaa

SEQ ID NO: 30994 - DNA, 20 bp, Artificial Sequence
  Description of Artificial Sequence: Synthetic oligonucleotide
  Target: FXN; (+) strand; PAM type: YTN; PAM sequence: TTC
tgtgacatacaaaaaaaatc

SEQ ID NO: 30995 - DNA, 20 bp, Artificial Sequence
  Description of Artificial Sequence: Synthetic oligonucleotide
  Target: FXN; (+) strand; PAM type: YTN; PAM sequence: CTG
tgacatacaaaaaaaatcag

SEQ ID NO: 30996 - DNA, 20 bp, Artificial Sequence
  Description of Artificial Sequence: Synthetic oligonucleotide
  Target: FXN; (+) strand; PAM type: YTN; PAM sequence: CTT
gcatactcttttcgtactca

SEQ ID NO: 30997 - DNA, 20 bp, Artificial Sequence
  Description of Artificial Sequence: Synthetic oligonucleotide
  Target: FXN; (+) strand; PAM type: YTN; PAM sequence: TTG
catactcttttcgtactcat

SEQ ID NO: 30998 - DNA, 20 bp, Artificial Sequence
  Description of Artificial Sequence: Synthetic oligonucleotide
  Target: FXN; (+) strand; PAM type: YTN; PAM sequence: CTC
ttttcgtactcatatacttc

SEQ ID NO: 30999 - DNA, 20 bp, Artificial Sequence
  Description of Artificial Sequence: Synthetic oligonucleotide
  Target: FXN; (+) strand; PAM type: YTN; PAM sequence: CTT
ttcgtactcatatacttcca

SEQ ID NO: 31000 - DNA, 20 bp, Artificial Sequence
  Description of Artificial Sequence: Synthetic oligonucleotide
  Target: FXN; (+) strand; PAM type: YTN; PAM sequence: TTT
tcgtactcatatacttccag

SEQ ID NO: 31001 - DNA, 20 bp, Artificial Sequence
  Description of Artificial Sequence: Synthetic oligonucleotide
  Target: FXN; (+) strand; PAM type: YTN; PAM sequence: TTT
cgtactcatatacttccagc

SEQ ID NO: 31002 - DNA, 20 bp, Artificial Sequence
  Description of Artificial Sequence: Synthetic oligonucleotide
  Target: FXN; (+) strand; PAM type: YTN; PAM sequence: TTC
gtactcatatacttccagca

SEQ ID NO: 31003 - DNA, 20 bp, Artificial Sequence
  Description of Artificial Sequence: Synthetic oligonucleotide
  Target: FXN; (+) strand; PAM type: YTN; PAM sequence: CTC
atatacttccagcatatctc

SEQ ID NO: 31004 - DNA, 20 bp, Artificial Sequence
  Description of Artificial Sequence: Synthetic oligonucleotide
  Target: FXN; (+) strand; PAM type: YTN; PAM sequence: CTT
ccagcatatctcaattcaca

SEQ ID NO: 31005 - DNA, 20 bp, Artificial Sequence
  Description of Artificial Sequence: Synthetic oligonucleotide
  Target: FXN; (+) strand; PAM type: YTN; PAM sequence: TTC
cagcatatctcaattcacaa

SEQ ID NO: 31006 - DNA, 20 bp, Artificial Sequence
  Description of Artificial Sequence: Synthetic oligonucleotide
  Target: FXN; (+) strand; PAM type: YTN; PAM sequence: CTC
aattcacaatttctaagtaa

SEQ ID NO: 31007 - DNA, 20 bp, Artificial Sequence
  Description of Artificial Sequence: Synthetic oligonucleotide
  Target: FXN; (+) strand; PAM type: YTN; PAM sequence: TTC
acaatttctaagtaaatgct

SEQ ID NO: 31008 - DNA, 20 bp, Artificial Sequence
  Description of Artificial Sequence: Synthetic oligonucleotide
  Target: FXN; (+) strand; PAM type: YTN; PAM sequence: TTT
ctaagtaaatgctctatctg

SEQ ID NO: 31009 - DNA, 20 bp, Artificial Sequence
  Description of Artificial Sequence: Synthetic oligonucleotide
  Target: FXN; (+) strand; PAM type: YTN; PAM sequence: TTC
taagtaaatgctctatctgt

SEQ ID NO: 31010 - DNA, 20 bp, Artificial Sequence
  Description of Artificial Sequence: Synthetic oligonucleotide
  Target: FXN; (+) strand; PAM type: YTN; PAM sequence: CTA
agtaaatgctctatctgtat

SEQ ID NO: 31011 - DNA, 20 bp, Artificial Sequence
  Description of Artificial Sequence: Synthetic oligonucleotide
  Target: FXN; (+) strand; PAM type: YTN; PAM sequence: CTC
tatctgtatttacttttata

SEQ ID NO: 31012 - DNA, 20 bp, Artificial Sequence
  Description of Artificial Sequence: Synthetic oligonucleotide
  Target: FXN; (+) strand; PAM type: YTN; PAM sequence: CTA
tctgtatttacttttataaa

SEQ ID NO: 31013 - DNA, 20 bp, Artificial Sequence
  Description of Artificial Sequence: Synthetic oligonucleotide
  Target: FXN; (+) strand; PAM type: YTN; PAM sequence: CTG
tatttacttttataaaattc

SEQ ID NO: 31014 - DNA, 20 bp, Artificial Sequence
  Description of Artificial Sequence: Synthetic oligonucleotide
  Target: FXN; (+) strand; PAM type: YTN; PAM sequence: TTT
acttttataaaattcacaat

SEQ ID NO: 31015 - DNA, 20 bp, Artificial Sequence
  Description of Artificial Sequence: Synthetic oligonucleotide
  Target: FXN; (+) strand; PAM type: YTN; PAM sequence: TTA
cttttataaaattcacaatt

SEQ ID NO: 31016 - DNA, 20 bp, Artificial Sequence
  Description of Artificial Sequence: Synthetic oligonucleotide
  Target: FXN; (+) strand; PAM type: YTN; PAM sequence: CTT
ttataaaattcacaattaaa

SEQ ID NO: 31017 - DNA, 20 bp, Artificial Sequence
  Description of Artificial Sequence: Synthetic oligonucleotide
  Target: FXN; (+) strand; PAM type: YTN; PAM sequence: TTT
tataaaattcacaattaaaa

SEQ ID NO: 31018 - DNA, 20 bp, Artificial Sequence
  Description of Artificial Sequence: Synthetic oligonucleotide
  Target: FXN; (+) strand; PAM type: YTN; PAM sequence: TTT
ataaaattcacaattaaaaa

SEQ ID NO: 31019 - DNA, 20 bp, Artificial Sequence
  Description of Artificial Sequence: Synthetic oligonucleotide
  Target: FXN; (+) strand; PAM type: YTN; PAM sequence: TTA
taaaattcacaattaaaaat

SEQ ID NO: 31020 - DNA, 20 bp, Artificial Sequence
  Description of Artificial Sequence: Synthetic oligonucleotide
  Target: FXN; (+) strand; PAM type: YTN; PAM sequence: TTC
acaattaaaaatgaaggttc

SEQ ID NO: 31021 - DNA, 20 bp, Artificial Sequence
  Description of Artificial Sequence: Synthetic oligonucleotide
  Target: FXN; (+) strand; PAM type: YTN; PAM sequence: TTA
aaaatgaaggttcacatagt

SEQ ID NO: 31022 - DNA, 20 bp, Artificial Sequence
  Description of Artificial Sequence: Synthetic oligonucleotide
  Target: FXN; (+) strand; PAM type: YTN; PAM sequence: TTC
acatagtcaagttgttccaa

SEQ ID NO: 31023 - DNA, 20 bp, Artificial Sequence
  Description of Artificial Sequence: Synthetic oligonucleotide
  Target: FXN; (+) strand; PAM type: YTN; PAM sequence: TTG
ttccaaacacacttaaatgt

SEQ ID NO: 31024 - DNA, 20 bp, Artificial Sequence
  Description of Artificial Sequence: Synthetic oligonucleotide
  Target: FXN; (+) strand; PAM type: YTN; PAM sequence: TTC
caaacacacttaaatgtctc

SEQ ID NO: 31025 - DNA, 20 bp, Artificial Sequence
  Description of Artificial Sequence: Synthetic oligonucleotide
  Target: FXN; (+) strand; PAM type: YTN; PAM sequence: CTT
aaatgtctcctaggctgggt

SEQ ID NO: 31026 - DNA, 20 bp, Artificial Sequence
  Description of Artificial Sequence: Synthetic oligonucleotide
  Target: FXN; (+) strand; PAM type: YTN; PAM sequence: TTA
aatgtctcctaggctgggtg

SEQ ID NO: 31027 - DNA, 20 bp, Artificial Sequence
  Description of Artificial Sequence: Synthetic oligonucleotide
  Target: FXN; (+) strand; PAM type: YTN; PAM sequence: CTC
ctaggctgggtgtggttgct

SEQ ID NO: 31028 - DNA, 20 bp, Artificial Sequence
  Description of Artificial Sequence: Synthetic oligonucleotide
  Target: FXN; (+) strand; PAM type: YTN; PAM sequence: CTA
ggctgggtgtggttgctcac

SEQ ID NO: 31029 - DNA, 20 bp, Artificial Sequence
  Description of Artificial Sequence: Synthetic oligonucleotide
  Target: FXN; (+) strand; PAM type: YTN; PAM sequence: CTG
ggtgtggttgctcacacctg

SEQ ID NO: 31030 - DNA, 20 bp, Artificial Sequence
  Description of Artificial Sequence: Synthetic oligonucleotide
  Target: FXN; (+) strand; PAM type: YTN; PAM sequence: TTG
ctcacacctgtaatcccagc

SEQ ID NO: 31031 - DNA, 20 bp, Artificial Sequence
  Description of Artificial Sequence: Synthetic oligonucleotide
  Target: FXN; (+) strand; PAM type: YTN; PAM sequence: CTC
acacctgtaatcccagcact

SEQ ID NO: 31032 - DNA, 20 bp, Artificial Sequence
  Description of Artificial Sequence: Synthetic oligonucleotide
  Target: FXN; (+) strand; PAM type: YTN; PAM sequence: CTG
taatcccagcactttgggag

SEQ ID NO: 31033 - DNA, 20 bp, Artificial Sequence
  Description of Artificial Sequence: Synthetic oligonucleotide
  Target: FXN; (+) strand; PAM type: YTN; PAM sequence: CTT
tgggaggctgagatgggcgg

SEQ ID NO: 31034 - DNA, 20 bp, Artificial Sequence
  Description of Artificial Sequence: Synthetic oligonucleotide
  Target: FXN; (+) strand; PAM type: YTN; PAM sequence: TTT
gggaggctgagatgggcgga

SEQ ID NO: 31035 - DNA, 20 bp, Artificial Sequence
  Description of Artificial Sequence: Synthetic oligonucleotide
  Target: FXN; (+) strand; PAM type: YTN; PAM sequence: TTG
ggaggctgagatgggcggat

SEQ ID NO: 31036 - DNA, 20 bp, Artificial Sequence
  Description of Artificial Sequence: Synthetic oligonucleotide
  Target: FXN; (+) strand; PAM type: YTN; PAM sequence: CTG
agatgggcggatcacctgag

SEQ ID NO: 31037 - DNA, 20 bp, Artificial Sequence
  Description of Artificial Sequence: Synthetic oligonucleotide
  Target: FXN; (+) strand; PAM type: YTN; PAM sequence: CTG
aggtcaggagtttgagacca

SEQ ID NO: 31038 - DNA, 20 bp, Artificial Sequence
  Description of Artificial Sequence: Synthetic oligonucleotide
  Target: FXN; (+) strand; PAM type: YTN; PAM sequence: TTT
gagaccagcctggccaacat

SEQ ID NO: 31039 - DNA, 20 bp, Artificial Sequence
  Description of Artificial Sequence: Synthetic oligonucleotide
  Target: FXN; (+) strand; PAM type: YTN; PAM sequence: TTG
agaccagcctggccaacatg

SEQ ID NO: 31040 - DNA, 20 bp, Artificial Sequence
  Description of Artificial Sequence: Synthetic oligonucleotide
  Target: FXN; (+) strand; PAM type: YTN; PAM sequence: CTG
gccaacatggtgaaaccccg

SEQ ID NO: 31041 - DNA, 20 bp, Artificial Sequence
  Description of Artificial Sequence: Synthetic oligonucleotide
  Target: FXN; (+) strand; PAM type: YTN; PAM sequence: CTC
tactaaaaatacaaaaatta

SEQ ID NO: 31042 - DNA, 20 bp, Artificial Sequence
  Description of Artificial Sequence: Synthetic oligonucleotide
  Target: FXN; (+) strand; PAM type: YTN; PAM sequence: CTA
ctaaaaatacaaaaattagc

SEQ ID NO: 31043 - DNA, 20 bp, Artificial Sequence
  Description of Artificial Sequence: Synthetic oligonucleotide
  Target: FXN; (+) strand; PAM type: YTN; PAM sequence: CTA
aaaatacaaaaattagctgg

SEQ ID NO: 31044 - DNA, 20 bp, Artificial Sequence
  Description of Artificial Sequence: Synthetic oligonucleotide
  Target: FXN; (+) strand; PAM type: YTN; PAM sequence: TTA
gctggatgtggtggcactca

SEQ ID NO: 31045 - DNA, 20 bp, Artificial Sequence
  Description of Artificial Sequence: Synthetic oligonucleotide
  Target: FXN; (+) strand; PAM type: YTN; PAM sequence: CTG
gatgtggtggcactcacctg

SEQ ID NO: 31046 - DNA, 20 bp, Artificial Sequence
  Description of Artificial Sequence: Synthetic oligonucleotide
  Target: FXN; (+) strand; PAM type: YTN; PAM sequence: CTC
acctgtaatcccagctactc

SEQ ID NO: 31047 - DNA, 20 bp, Artificial Sequence
  Description of Artificial Sequence: Synthetic oligonucleotide
  Target: FXN; (+) strand; PAM type: YTN; PAM sequence: CTG
taatcccagctactcaggag

SEQ ID NO: 31048 - DNA, 20 bp, Artificial Sequence
  Description of Artificial Sequence: Synthetic oligonucleotide
  Target: FXN; (+) strand; PAM type: YTN; PAM sequence: CTA
ctcaggaggctgaggcagga

SEQ ID NO: 31049 - DNA, 20 bp, Artificial Sequence
  Description of Artificial Sequence: Synthetic oligonucleotide
  Target: FXN; (+) strand; PAM type: YTN; PAM sequence: CTC
aggaggctgaggcaggataa

SEQ ID NO: 31050 - DNA, 20 bp, Artificial Sequence
  Description of Artificial Sequence: Synthetic oligonucleotide
  Target: FXN; (+) strand; PAM type: YTN; PAM sequence: CTG
aggcaggataattgcttgaa

SEQ ID NO: 31051 - DNA, 20 bp, Artificial Sequence
  Description of Artificial Sequence: Synthetic oligonucleotide
  Target: FXN; (+) strand; PAM type: YTN; PAM sequence: TTG
cttgaacccgggaggtggtg

SEQ ID NO: 31052 - DNA, 20 bp, Artificial Sequence
  Description of Artificial Sequence: Synthetic oligonucleotide
  Target: FXN; (+) strand; PAM type: YTN; PAM sequence: CTT
gaacccgggaggtggtggag

SEQ ID NO: 31053 - DNA, 20 bp, Artificial Sequence
  Description of Artificial Sequence: Synthetic oligonucleotide
  Target: FXN; (+) strand; PAM type: YTN; PAM sequence: TTG
aacccgggaggtggtggagg

SEQ ID NO: 31054 - DNA, 20 bp, Artificial Sequence
  Description of Artificial Sequence: Synthetic oligonucleotide
  Target: FXN; (+) strand; PAM type: YTN; PAM sequence: TTG
cagtgagccgagatcgcacc

SEQ ID NO: 31055 - DNA, 20 bp, Artificial Sequence
  Description of Artificial Sequence: Synthetic oligonucleotide
  Target: FXN; (+) strand; PAM type: YTN; PAM sequence: CTG
ccttccaacctgggcgacag

SEQ ID NO: 31056 - DNA, 20 bp, Artificial Sequence
  Description of Artificial Sequence: Synthetic oligonucleotide
  Target: FXN; (+) strand; PAM type: YTN; PAM sequence: CTT
ccaacctgggcgacagagcg

SEQ ID NO: 31057 - DNA, 20 bp, Artificial Sequence
  Description of Artificial Sequence: Synthetic oligonucleotide
  Target: FXN; (+) strand; PAM type: YTN; PAM sequence: TTC
caacctgggcgacagagcga

SEQ ID NO: 31058 - DNA, 20 bp, Artificial Sequence
  Description of Artificial Sequence: Synthetic oligonucleotide
  Target: FXN; (+) strand; PAM type: YTN; PAM sequence: CTG
ggcgacagagcgagactccg

SEQ ID NO: 31059 - DNA, 20 bp, Artificial Sequence
  Description of Artificial Sequence: Synthetic oligonucleotide
  Target: FXN; (+) strand; PAM type: YTN; PAM sequence: CTC
cgtctcaaaaaaaaaaaaaa

SEQ ID NO: 31060 - DNA, 20 bp, Artificial Sequence
  Description of Artificial Sequence: Synthetic oligonucleotide
  Target: FXN; (+) strand; PAM type: YTN; PAM sequence: CTC
aaaaaaaaaaaaaaggctcc

SEQ ID NO: 31061 - DNA, 20 bp, Artificial Sequence
  Description of Artificial Sequence: Synthetic oligonucleotide
  Target: FXN; (+) strand; PAM type: YTN; PAM sequence: CTC
ctaataactttattacttta

SEQ ID NO: 31062 - DNA, 20 bp, Artificial Sequence
  Description of Artificial Sequence: Synthetic oligonucleotide
  Target: FXN; (+) strand; PAM type: YTN; PAM sequence: CTA
ataactttattactttatta

SEQ ID NO: 31063 - DNA, 20 bp, Artificial Sequence
  Description of Artificial Sequence: Synthetic oligonucleotide
  Target: FXN; (+) strand; PAM type: YTN; PAM sequence: CTT
tattactttattatcacctc

SEQ ID NO: 31064 - DNA, 20 bp, Artificial Sequence
  Description of Artificial Sequence: Synthetic oligonucleotide
  Target: FXN; (+) strand; PAM type: YTN; PAM sequence: TTT
attactttattatcacctca

SEQ ID NO: 31065 - DNA, 20 bp, Artificial Sequence
  Description of Artificial Sequence: Synthetic oligonucleotide
  Target: FXN; (+) strand; PAM type: YTN; PAM sequence: TTA
ttactttattatcacctcaa

SEQ ID NO: 31066 - DNA, 20 bp, Artificial Sequence
  Description of Artificial Sequence: Synthetic oligonucleotide
  Target: FXN; (+) strand; PAM type: YTN; PAM sequence: TTA
ctttattatcacctcaaata

SEQ ID NO: 31067 - DNA, 20 bp, Artificial Sequence
  Description of Artificial Sequence: Synthetic oligonucleotide
  Target: FXN; (+) strand; PAM type: YTN; PAM sequence: CTT
tattatcacctcaaataatt

SEQ ID NO: 31068 - DNA, 20 bp, Artificial Sequence
  Description of Artificial Sequence: Synthetic oligonucleotide
  Target: FXN; (+) strand; PAM type: YTN; PAM sequence: TTT
attatcacctcaaataatta

SEQ ID NO: 31069 - DNA, 20 bp, Artificial Sequence
  Description of Artificial Sequence: Synthetic oligonucleotide
  Target: FXN; (+) strand; PAM type: YTN; PAM sequence: TTA
ttatcacctcaaataattaa

SEQ ID NO: 31070 - DNA, 20 bp, Artificial Sequence
  Description of Artificial Sequence: Synthetic oligonucleotide
  Target: FXN; (+) strand; PAM type: YTN; PAM sequence: TTA
tcacctcaaataattaaaat

SEQ ID NO: 31071 - DNA, 20 bp, Artificial Sequence
  Description of Artificial Sequence: Synthetic oligonucleotide
  Target: FXN; (+) strand; PAM type: YTN; PAM sequence: CTC
aaataattaaaattaaatga

SEQ ID NO: 31072 - DNA, 20 bp, Artificial Sequence
  Description of Artificial Sequence: Synthetic oligonucleotide
  Target: FXN; (+) strand; PAM type: YTN; PAM sequence: TTA
aaattaaatgaagttgaaaa

SEQ ID NO: 31073 - DNA, 20 bp, Artificial Sequence
  Description of Artificial Sequence: Synthetic oligonucleotide
  Target: FXN; (+) strand; PAM type: YTN; PAM sequence: TTA
aatgaagttgaaaatccagg

SEQ ID NO: 31074 - DNA, 20 bp, Artificial Sequence
  Description of Artificial Sequence: Synthetic oligonucleotide
  Target: FXN; (+) strand; PAM type: YTN; PAM sequence: TTG
aaaatccaggtcctcagtcc

SEQ ID NO: 31075 - DNA, 20 bp, Artificial Sequence
  Description of Artificial Sequence: Synthetic oligonucleotide
  Target: FXN; (+) strand; PAM type: YTN; PAM sequence: CTC
agtcccattagccacatttc

SEQ ID NO: 31076 - DNA, 20 bp, Artificial Sequence
  Description of Artificial Sequence: Synthetic oligonucleotide
  Target: FXN; (+) strand; PAM type: YTN; PAM sequence: TTA
gccacatttctagtgctcag

SEQ ID NO: 31077 - DNA, 20 bp, Artificial Sequence
  Description of Artificial Sequence: Synthetic oligonucleotide
  Target: FXN; (+) strand; PAM type: YTN; PAM sequence: TTT
ctagtgctcagtagccacgg

SEQ ID NO: 31078 - DNA, 20 bp, Artificial Sequence
  Description of Artificial Sequence: Synthetic oligonucleotide
  Target: FXN; (+) strand; PAM type: YTN; PAM sequence: TTC
tagtgctcagtagccacggg

SEQ ID NO: 31079 - DNA, 20 bp, Artificial Sequence
  Description of Artificial Sequence: Synthetic oligonucleotide
  Target: FXN; (+) strand; PAM type: YTN; PAM sequence: CTA
gtgctcagtagccacggggg

SEQ ID NO: 31080 - DNA, 20 bp, Artificial Sequence
  Description of Artificial Sequence: Synthetic oligonucleotide
  Target: FXN; (+) strand; PAM type: YTN; PAM sequence: CTC
agtagccacgggggctggtg

SEQ ID NO: 31081 - DNA, 20 bp, Artificial Sequence
  Description of Artificial Sequence: Synthetic oligonucleotide
  Target: FXN; (+) strand; PAM type: YTN; PAM sequence: CTG
gtgaccaccacatgggacag

SEQ ID NO: 31082 - DNA, 20 bp, Artificial Sequence
  Description of Artificial Sequence: Synthetic oligonucleotide
  Target: FXN; (+) strand; PAM type: YTN; PAM sequence: TTT
agtacctgatcattggttct

SEQ ID NO: 31083 - DNA, 20 bp, Artificial Sequence
  Description of Artificial Sequence: Synthetic oligonucleotide
  Target: FXN; (+) strand; PAM type: YTN; PAM sequence: TTA
gtacctgatcattggttctc

SEQ ID NO: 31084 - DNA, 20 bp, Artificial Sequence
  Description of Artificial Sequence: Synthetic oligonucleotide
  Target: FXN; (+) strand; PAM type: YTN; PAM sequence: CTG
atcattggttctcagatctg

SEQ ID NO: 31085 - DNA, 20 bp, Artificial Sequence
  Description of Artificial Sequence: Synthetic oligonucleotide
  Target: FXN; (+) strand; PAM type: YTN; PAM sequence: TTG
gttctcagatctggctactc

SEQ ID NO: 31086 - DNA, 20 bp, Artificial Sequence
  Description of Artificial Sequence: Synthetic oligonucleotide
  Target: FXN; (+) strand; PAM type: YTN; PAM sequence: TTC
tcagatctggctactcagca

SEQ ID NO: 31087 - DNA, 20 bp, Artificial Sequence
  Description of Artificial Sequence: Synthetic oligonucleotide
  Target: FXN; (+) strand; PAM type: YTN; PAM sequence: CTC
agatctggctactcagcaga

SEQ ID NO: 31088 - DNA, 20 bp, Artificial Sequence
  Description of Artificial Sequence: Synthetic oligonucleotide
  Target: FXN; (+) strand; PAM type: YTN; PAM sequence: CTG
gctactcagcagaaccaaga

SEQ ID NO: 31089 - DNA, 20 bp, Artificial Sequence
  Description of Artificial Sequence: Synthetic oligonucleotide
  Target: FXN; (+) strand; PAM type: YTN; PAM sequence: CTA
ctcagcagaaccaagaatcc

SEQ ID NO: 31090 - DNA, 20 bp, Artificial Sequence
  Description of Artificial Sequence: Synthetic oligonucleotide
  Target: FXN; (+) strand; PAM type: YTN; PAM sequence: CTC
agcagaaccaagaatccaca

SEQ ID NO: 31091 - DNA, 20 bp, Artificial Sequence
  Description of Artificial Sequence: Synthetic oligonucleotide
  Target: FXN; (+) strand; PAM type: YTN; PAM sequence: CTT
ttaaaagcacagccccacag

SEQ ID NO: 31092 - DNA, 20 bp, Artificial Sequence
  Description of Artificial Sequence: Synthetic oligonucleotide
  Target: FXN; (+) strand; PAM type: YTN; PAM sequence: TTT
taaaagcacagccccacagc

SEQ ID NO: 31093 - DNA, 20 bp, Artificial Sequence
  Description of Artificial Sequence: Synthetic oligonucleotide
  Target: FXN; (+) strand; PAM type: YTN; PAM sequence: TTT
aaaagcacagccccacagcc

SEQ ID NO: 31094 - DNA, 20 bp, Artificial Sequence
  Description of Artificial Sequence: Synthetic oligonucleotide
  Target: FXN; (+) strand; PAM type: YTN; PAM sequence: TTA
aaagcacagccccacagccc

SEQ ID NO: 31095 - DNA, 20 bp, Artificial Sequence
  Description of Artificial Sequence: Synthetic oligonucleotide
  Target: FXN; (+) strand; PAM type: YTN; PAM sequence: CTT
acctacctggaggctgggaa

SEQ ID NO: 31096 - DNA, 20 bp, Artificial Sequence
  Description of Artificial Sequence: Synthetic oligonucleotide
  Target: FXN; (+) strand; PAM type: YTN; PAM sequence: TTA
cctacctggaggctgggaag

SEQ ID NO: 31097 - DNA, 20 bp, Artificial Sequence
  Description of Artificial Sequence: Synthetic oligonucleotide
  Target: FXN; (+) strand; PAM type: YTN; PAM sequence: CTA
cctggaggctgggaaggact

SEQ ID NO: 31098 - DNA, 20 bp, Artificial Sequence
  Description of Artificial Sequence: Synthetic oligonucleotide
  Target: FXN; (+) strand; PAM type: YTN; PAM sequence: CTG
gaggctgggaaggactctga

SEQ ID NO: 31099 - DNA, 20 bp, Artificial Sequence
  Description of Artificial Sequence: Synthetic oligonucleotide
  Target: FXN; (+) strand; PAM type: YTN; PAM sequence: CTG
ggaaggactctgattccacg

SEQ ID NO: 31100 - DNA, 20 bp, Artificial Sequence
  Description of Artificial Sequence: Synthetic oligonucleotide
  Target: FXN; (+) strand; PAM type: YTN; PAM sequence: CTC
tgattccacgaggcagccta

SEQ ID NO: 31101 - DNA, 20 bp, Artificial Sequence
  Description of Artificial Sequence: Synthetic oligonucleotide
  Target: FXN; (+) strand; PAM type: YTN; PAM sequence: CTG
attccacgaggcagcctatg

SEQ ID NO: 31102 - DNA, 20 bp, Artificial Sequence
  Description of Artificial Sequence: Synthetic oligonucleotide
  Target: FXN; (+) strand; PAM type: YTN; PAM sequence: TTC
cacgaggcagcctatgtttt

SEQ ID NO: 31103 - DNA, 20 bp, Artificial Sequence
  Description of Artificial Sequence: Synthetic oligonucleotide
  Target: FXN; (+) strand; PAM type: YTN; PAM sequence: CTA
tgttttttgatggagggatg

SEQ ID NO: 31104 - DNA, 20 bp, Artificial Sequence
  Description of Artificial Sequence: Synthetic oligonucleotide
  Target: FXN; (+) strand; PAM type: YTN; PAM sequence: TTT
tttgatggagggatgtgaca

SEQ ID NO: 31105 - DNA, 20 bp, Artificial Sequence
  Description of Artificial Sequence: Synthetic oligonucleotide
  Target: FXN; (+) strand; PAM type: YTN; PAM sequence: TTT
ttgatggagggatgtgacag

SEQ ID NO: 31106 - DNA, 20 bp, Artificial Sequence
  Description of Artificial Sequence: Synthetic oligonucleotide
  Target: FXN; (+) strand; PAM type: YTN; PAM sequence: TTT
tgatggagggatgtgacagg

SEQ ID NO: 31107 - DNA, 20 bp, Artificial Sequence
  Description of Artificial Sequence: Synthetic oligonucleotide
  Target: FXN; (+) strand; PAM type: YTN; PAM sequence: TTT
gatggagggatgtgacaggg

SEQ ID NO: 31108 - DNA, 20 bp, Artificial Sequence
  Description of Artificial Sequence: Synthetic oligonucleotide
  Target: FXN; (+) strand; PAM type: YTN; PAM sequence: TTG
atggagggatgtgacagggg

SEQ ID NO: 31109 - DNA, 20 bp, Artificial Sequence
  Description of Artificial Sequence: Synthetic oligonucleotide
  Target: FXN; (+) strand; PAM type: YTN; PAM sequence: CTG
catctttaacgtttcctctt

SEQ ID NO: 31110 - DNA, 20 bp, Artificial Sequence
  Description of Artificial Sequence: Synthetic oligonucleotide
  Target: FXN; (+) strand; PAM type: YTN; PAM sequence: CTT
taacgtttcctcttaaatac

SEQ ID NO: 31111 - DNA, 20 bp, Artificial Sequence
  Description of Artificial Sequence: Synthetic oligonucleotide
  Target: FXN; (+) strand; PAM type: YTN; PAM sequence: TTT
aacgtttcctcttaaatact

SEQ ID NO: 31112 - DNA, 20 bp, Artificial Sequence
  Description of Artificial Sequence: Synthetic oligonucleotide
  Target: FXN; (+) strand; PAM type: YTN; PAM sequence: TTA
acgtttcctcttaaatactg

SEQ ID NO: 31113 - DNA, 20 bp, Artificial Sequence
  Description of Artificial Sequence: Synthetic oligonucleotide
  Target: FXN; (+) strand; PAM type: YTN; PAM sequence: TTT
cctcttaaatactggagaca

SEQ ID NO: 31114 - DNA, 20 bp, Artificial Sequence
  Description of Artificial Sequence: Synthetic oligonucleotide
  Target: FXN; (+) strand; PAM type: YTN; PAM sequence: TTC
ctcttaaatactggagacag

SEQ ID NO: 31115 - DNA, 20 bp, Artificial Sequence
  Description of Artificial Sequence: Synthetic oligonucleotide
  Target: FXN; (+) strand; PAM type: YTN; PAM sequence: CTC
ttaaatactggagacagctt

SEQ ID NO: 31116 - DNA, 20 bp, Artificial Sequence
  Description of Artificial Sequence: Synthetic oligonucleotide
  Target: FXN; (+) strand; PAM type: YTN; PAM sequence: CTT
aaatactggagacagcttcg

SEQ ID NO: 31117 - DNA, 20 bp, Artificial Sequence
  Description of Artificial Sequence: Synthetic oligonucleotide
  Target: FXN; (+) strand; PAM type: YTN; PAM sequence: TTA
aatactggagacagcttcga

SEQ ID NO: 31118 - DNA, 20 bp, Artificial Sequence
  Description of Artificial Sequence: Synthetic oligonucleotide
  Target: FXN; (+) strand; PAM type: YTN; PAM sequence: CTG
gagacagcttcgaggaggag

SEQ ID NO: 31119 - DNA, 20 bp, Artificial Sequence
  Description of Artificial Sequence: Synthetic oligonucleotide
  Target: FXN; (+) strand; PAM type: YTN; PAM sequence: CTT
cgaggaggagataactggat

SEQ ID NO: 31120 - DNA, 20 bp, Artificial Sequence
  Description of Artificial Sequence: Synthetic oligonucleotide
  Target: FXN; (+) strand; PAM type: YTN; PAM sequence: TTC
gaggaggagataactggatg

SEQ ID NO: 31121 - DNA, 20 bp, Artificial Sequence
  Description of Artificial Sequence: Synthetic oligonucleotide
  Target: FXN; (+) strand; PAM type: YTN; PAM sequence: CTG
gatgtgtcttagtccatttg

SEQ ID NO: 31122 - DNA, 20 bp, Artificial Sequence
  Description of Artificial Sequence: Synthetic oligonucleotide
  Target: FXN; (+) strand; PAM type: YTN; PAM sequence: CTT
agtccatttgatggagggat

SEQ ID NO: 31123 - DNA, 20 bp, Artificial Sequence
  Description of Artificial Sequence: Synthetic oligonucleotide
  Target: FXN; (+) strand; PAM type: YTN; PAM sequence: TTA
gtccatttgatggagggatg

SEQ ID NO: 31124 - DNA, 20 bp, Artificial Sequence
  Description of Artificial Sequence: Synthetic oligonucleotide
  Target: FXN; (+) strand; PAM type: YTN; PAM sequence: TTT
gatggagggatgtgacgggg

SEQ ID NO: 31125 - DNA, 20 bp, Artificial Sequence
  Description of Artificial Sequence: Synthetic oligonucleotide
  Target: FXN; (+) strand; PAM type: YTN; PAM sequence: TTG
atggagggatgtgacggggc

SEQ ID NO: 31126 - DNA, 20 bp, Artificial Sequence
  Description of Artificial Sequence: Synthetic oligonucleotide
  Target: FXN; (+) strand; PAM type: YTN; PAM sequence: CTG
cgtctttaacgtttcctctt

SEQ ID NO: 31127 - DNA, 20 bp, Artificial Sequence
  Description of Artificial Sequence: Synthetic oligonucleotide
  Target: FXN; (+) strand; PAM type: YTN; PAM sequence: CTT
taacgtttcctcttaaatac

SEQ ID NO: 31128 - DNA, 20 bp, Artificial Sequence
  Description of Artificial Sequence: Synthetic oligonucleotide
  Target: FXN; (+) strand; PAM type: YTN; PAM sequence: TTT
aacgtttcctcttaaatacc

SEQ ID NO: 31129 - DNA, 20 bp, Artificial Sequence
  Description of Artificial Sequence: Synthetic oligonucleotide
  Target: FXN; (+) strand; PAM type: YTN; PAM sequence: TTA
acgtttcctcttaaataccg

SEQ ID NO: 31130 - DNA, 20 bp, Artificial Sequence
  Description of Artificial Sequence: Synthetic oligonucleotide
  Target: FXN; (+) strand; PAM type: YTN; PAM sequence: TTT
cctcttaaataccggagaca

SEQ ID NO: 31131 - DNA, 20 bp, Artificial Sequence
  Description of Artificial Sequence: Synthetic oligonucleotide
  Target: FXN; (+) strand; PAM type: YTN; PAM sequence: TTC
ctcttaaataccggagacag

SEQ ID NO: 31132 - DNA, 20 bp, Artificial Sequence
  Description of Artificial Sequence: Synthetic oligonucleotide
  Target: FXN; (+) strand; PAM type: YTN; PAM sequence: CTC
ttaaataccggagacagctt

SEQ ID NO: 31133 - DNA, 20 bp, Artificial Sequence
  Description of Artificial Sequence: Synthetic oligonucleotide
  Target: FXN; (+) strand; PAM type: YTN; PAM sequence: CTT
aaataccggagacagcttcg

SEQ ID NO: 31134 - DNA, 20 bp, Artificial Sequence
  Description of Artificial Sequence: Synthetic oligonucleotide
  Target: FXN; (+) strand; PAM type: YTN; PAM sequence: TTA
aataccggagacagcttcga

SEQ ID NO: 31135 - DNA, 20 bp, Artificial Sequence
  Description of Artificial Sequence: Synthetic oligonucleotide
  Target: FXN; (+) strand; PAM type: YTN; PAM sequence: CTT
cgagaaggagataactggat

SEQ ID NO: 31136 - DNA, 20 bp, Artificial Sequence
  Description of Artificial Sequence: Synthetic oligonucleotide
  Target: FXN; (+) strand; PAM type: YTN; PAM sequence: TTC
gagaaggagataactggatg

SEQ ID NO: 31137 - DNA, 20 bp, Artificial Sequence
  Description of Artificial Sequence: Synthetic oligonucleotide
  Target: FXN; (+) strand; PAM type: YTN; PAM sequence: CTG
gatgtttcttagtccatttt

SEQ ID NO: 31138 - DNA, 20 bp, Artificial Sequence
  Description of Artificial Sequence: Synthetic oligonucleotide
  Target: FXN; (+) strand; PAM type: YTN; PAM sequence: TTT
cttagtccattttctgttgc

SEQ ID NO: 31139 - DNA, 20 bp, Artificial Sequence
  Description of Artificial Sequence: Synthetic oligonucleotide
  Target: FXN; (+) strand; PAM type: YTN; PAM sequence: TTC
ttagtccattttctgttgct

SEQ ID NO: 31140 - DNA, 20 bp, Artificial Sequence
  Description of Artificial Sequence: Synthetic oligonucleotide
  Target: FXN; (+) strand; PAM type: YTN; PAM sequence: CTT
agtccattttctgttgcttg

SEQ ID NO: 31141 - DNA, 20 bp, Artificial Sequence
  Description of Artificial Sequence: Synthetic oligonucleotide
  Target: FXN; (+) strand; PAM type: YTN; PAM sequence: TTA
gtccattttctgttgcttgt

SEQ ID NO: 31142 - DNA, 20 bp, Artificial Sequence
  Description of Artificial Sequence: Synthetic oligonucleotide
  Target: FXN; (+) strand; PAM type: YTN; PAM sequence: TTT
tctgttgcttgtgacagaat

SEQ ID NO: 31143 - DNA, 20 bp, Artificial Sequence
  Description of Artificial Sequence: Synthetic oligonucleotide
  Target: FXN; (+) strand; PAM type: YTN; PAM sequence: TTT
ctgttgcttgtgacagaata

SEQ ID NO: 31144 - DNA, 20 bp, Artificial Sequence
  Description of Artificial Sequence: Synthetic oligonucleotide
  Target: FXN; (+) strand; PAM type: YTN; PAM sequence: TTC
tgttgcttgtgacagaatac

SEQ ID NO: 31145 - DNA, 20 bp, Artificial Sequence
  Description of Artificial Sequence: Synthetic oligonucleotide
  Target: FXN; (+) strand; PAM type: YTN; PAM sequence: CTG
ttgcttgtgacagaatacct

SEQ ID NO: 31146 - DNA, 20 bp, Artificial Sequence
  Description of Artificial Sequence: Synthetic oligonucleotide
  Target: FXN; (+) strand; PAM type: YTN; PAM sequence: TTG
cttgtgacagaatacctgaa

SEQ ID NO: 31147 - DNA, 20 bp, Artificial Sequence
  Description of Artificial Sequence: Synthetic oligonucleotide
  Target: FXN; (+) strand; PAM type: YTN; PAM sequence: CTT
gtgacagaatacctgaaact

SEQ ID NO: 31148 - DNA, 20 bp, Artificial Sequence
  Description of Artificial Sequence: Synthetic oligonucleotide
  Target: FXN; (+) strand; PAM type: YTN; PAM sequence: TTG
tgacagaatacctgaaactg

SEQ ID NO: 31149 - DNA, 20 bp, Artificial Sequence
  Description of Artificial Sequence: Synthetic oligonucleotide
  Target: FXN; (+) strand; PAM type: YTN; PAM sequence: CTG
aaactgggcaatttatatgg

SEQ ID NO: 31150 - DNA, 20 bp, Artificial Sequence
  Description of Artificial Sequence: Synthetic oligonucleotide
  Target: FXN; (+) strand; PAM type: YTN; PAM sequence: CTG
ggcaatttatatggtaaaaa

SEQ ID NO: 31151 - DNA, 20 bp, Artificial Sequence
  Description of Artificial Sequence: Synthetic oligonucleotide
  Target: FXN; (+) strand; PAM type: YTN; PAM sequence: TTT
atatggtaaaaaattttctt

SEQ ID NO: 31152 - DNA, 20 bp, Artificial Sequence
  Description of Artificial Sequence: Synthetic oligonucleotide
  Target: FXN; (+) strand; PAM type: YTN; PAM sequence: TTA
tatggtaaaaaattttcttc

SEQ ID NO: 31153 - DNA, 20 bp, Artificial Sequence
  Description of Artificial Sequence: Synthetic oligonucleotide
  Target: FXN; (+) strand; PAM type: YTN; PAM sequence: TTT
tcttcttactgctctggagg

SEQ ID NO: 31154 - DNA, 20 bp, Artificial Sequence
  Description of Artificial Sequence: Synthetic oligonucleotide
  Target: FXN; (+) strand; PAM type: YTN; PAM sequence: TTT
cttcttactgctctggaggc

SEQ ID NO: 31155 - DNA, 20 bp, Artificial Sequence
  Description of Artificial Sequence: Synthetic oligonucleotide
  Target: FXN; (+) strand; PAM type: YTN; PAM sequence: TTC
ttcttactgctctggaggct

SEQ ID NO: 31156 - DNA, 20 bp, Artificial Sequence
  Description of Artificial Sequence: Synthetic oligonucleotide
  Target: FXN; (+) strand; PAM type: YTN; PAM sequence: CTT
cttactgctctggaggctga

SEQ ID NO: 31157 - DNA, 20 bp, Artificial Sequence
  Description of Artificial Sequence: Synthetic oligonucleotide
  Target: FXN; (+) strand; PAM type: YTN; PAM sequence: TTC
ttactgctctggaggctgag

SEQ ID NO: 31158 - DNA, 20 bp, Artificial Sequence
  Description of Artificial Sequence: Synthetic oligonucleotide
  Target: FXN; (+) strand; PAM type: YTN; PAM sequence: CTT
actgctctggaggctgagaa

SEQ ID NO: 31159 - DNA, 20 bp, Artificial Sequence
  Description of Artificial Sequence: Synthetic oligonucleotide
  Target: FXN; (+) strand; PAM type: YTN; PAM sequence: TTA
ctgctctggaggctgagaag

SEQ ID NO: 31160 - DNA, 20 bp, Artificial Sequence
  Description of Artificial Sequence: Synthetic oligonucleotide
  Target: FXN; (+) strand; PAM type: YTN; PAM sequence: CTG
ctctggaggctgagaagtcc

SEQ ID NO: 31161 - DNA, 20 bp, Artificial Sequence
  Description of Artificial Sequence: Synthetic oligonucleotide
  Target: FXN; (+) strand; PAM type: YTN; PAM sequence: CTC
tggaggctgagaagtccaaa

SEQ ID NO: 31162 - DNA, 20 bp, Artificial Sequence
  Description of Artificial Sequence: Synthetic oligonucleotide
  Target: FXN; (+) strand; PAM type: YTN; PAM sequence: CTG
gaggctgagaagtccaaagt

SEQ ID NO: 31163 - DNA, 20 bp, Artificial Sequence
  Description of Artificial Sequence: Synthetic oligonucleotide
  Target: FXN; (+) strand; PAM type: YTN; PAM sequence: CTG
agaagtccaaagtcaagtcc

SEQ ID NO: 31164 - DNA, 20 bp, Artificial Sequence
  Description of Artificial Sequence: Synthetic oligonucleotide
  Target: FXN; (+) strand; PAM type: YTN; PAM sequence: CTT
cttgctggtggggactttgc

SEQ ID NO: 31165 - DNA, 20 bp, Artificial Sequence
  Description of Artificial Sequence: Synthetic oligonucleotide
  Target: FXN; (+) strand; PAM type: YTN; PAM sequence: TTC
ttgctggtggggactttgca

SEQ ID NO: 31166 - DNA, 20 bp, Artificial Sequence
  Description of Artificial Sequence: Synthetic oligonucleotide
  Target: FXN; (+) strand; PAM type: YTN; PAM sequence: CTT
gctggtggggactttgcaga

SEQ ID NO: 31167 - DNA, 20 bp, Artificial Sequence
  Description of Artificial Sequence: Synthetic oligonucleotide
  Target: FXN; (+) strand; PAM type: YTN; PAM sequence: TTG
ctggtggggactttgcagag

SEQ ID NO: 31168 - DNA, 20 bp, Artificial Sequence
  Description of Artificial Sequence: Synthetic oligonucleotide
  Target: FXN; (+) strand; PAM type: YTN; PAM sequence: CTG
gtggggactttgcagagtat

SEQ ID NO: 31169 - DNA, 20 bp, Artificial Sequence
  Description of Artificial Sequence: Synthetic oligonucleotide
  Target: FXN; (+) strand; PAM type: YTN; PAM sequence: CTT
tgcagagtattgaggcggca

SEQ ID NO: 31170 - DNA, 20 bp, Artificial Sequence
  Description of Artificial Sequence: Synthetic oligonucleotide
  Target: FXN; (+) strand; PAM type: YTN; PAM sequence: TTT
gcagagtattgaggcggcac

SEQ ID NO: 31171 - DNA, 20 bp, Artificial Sequence
  Description of Artificial Sequence: Synthetic oligonucleotide
  Target: FXN; (+) strand; PAM type: YTN; PAM sequence: TTG
cagagtattgaggcggcacc

SEQ ID NO: 31172 - DNA, 20 bp, Artificial Sequence
  Description of Artificial Sequence: Synthetic oligonucleotide
  Target: FXN; (+) strand; PAM type: YTN; PAM sequence: TTG
aggcggcaccgggcgtcata

SEQ ID NO: 31173 - DNA, 20 bp, Artificial Sequence
  Description of Artificial Sequence: Synthetic oligonucleotide
  Target: FXN; (+) strand; PAM type: YTN; PAM sequence: CTG
agtgtgctacctcaggtgtc

SEQ ID NO: 31174 - DNA, 20 bp, Artificial Sequence
  Description of Artificial Sequence: Synthetic oligonucleotide
  Target: FXN; (+) strand; PAM type: YTN; PAM sequence: CTA
cctcaggtgtctttttcttt

SEQ ID NO: 31175 - DNA, 20 bp, Artificial Sequence
  Description of Artificial Sequence: Synthetic oligonucleotide
  Target: FXN; (+) strand; PAM type: YTN; PAM sequence: CTC
aggtgtctttttcttttctt

SEQ ID NO: 31176 - DNA, 20 bp, Artificial Sequence
  Description of Artificial Sequence: Synthetic oligonucleotide
  Target: FXN; (+) strand; PAM type: YTN; PAM sequence: CTT
tttcttttcttataaagcct

SEQ ID NO: 31177 - DNA, 20 bp, Artificial Sequence
  Description of Artificial Sequence: Synthetic oligonucleotide
  Target: FXN; (+) strand; PAM type: YTN; PAM sequence: TTT
ttcttttcttataaagccta

SEQ ID NO: 31178 - DNA, 20 bp, Artificial Sequence
  Description of Artificial Sequence: Synthetic oligonucleotide
  Target: FXN; (+) strand; PAM type: YTN; PAM sequence: TTT
tcttttcttataaagcctaa

SEQ ID NO: 31179 - DNA, 20 bp, Artificial Sequence
  Description of Artificial Sequence: Synthetic oligonucleotide
  Target: FXN; (+) strand; PAM type: YTN; PAM sequence: TTT
cttttcttataaagcctaac

SEQ ID NO: 31180 - DNA, 20 bp, Artificial Sequence
  Description of Artificial Sequence: Synthetic oligonucleotide
  Target: FXN; (+) strand; PAM type: YTN; PAM sequence: TTC
ttttcttataaagcctaact

SEQ ID NO: 31181 - DNA, 20 bp, Artificial Sequence
  Description of Artificial Sequence: Synthetic oligonucleotide
  Target: FXN; (+) strand; PAM type: YTN; PAM sequence: CTT
ttcttataaagcctaactag

SEQ ID NO: 31182 - DNA, 20 bp, Artificial Sequence
  Description of Artificial Sequence: Synthetic oligonucleotide
  Target: FXN; (+) strand; PAM type: YTN; PAM sequence: TTT
tcttataaagcctaactagt

SEQ ID NO: 31183 - DNA, 20 bp, Artificial Sequence
  Description of Artificial Sequence: Synthetic oligonucleotide
  Target: FXN; (+) strand; PAM type: YTN; PAM sequence: TTT
cttataaagcctaactagtt

SEQ ID NO: 31184 - DNA, 20 bp, Artificial Sequence
  Description of Artificial Sequence: Synthetic oligonucleotide
  Target: FXN; (+) strand; PAM type: YTN; PAM sequence: TTC
ttataaagcctaactagttt

SEQ ID NO: 31185 - DNA, 20 bp, Artificial Sequence
  Description of Artificial Sequence: Synthetic oligonucleotide
  Target: FXN; (+) strand; PAM type: YTN; PAM sequence: CTT
ataaagcctaactagtttca

SEQ ID NO: 31186 - DNA, 20 bp, Artificial Sequence
  Description of Artificial Sequence: Synthetic oligonucleotide
  Target: FXN; (+) strand; PAM type: YTN; PAM sequence: TTA
taaagcctaactagtttcac

SEQ ID NO: 31187 - DNA, 20 bp, Artificial Sequence
  Description of Artificial Sequence: Synthetic oligonucleotide
  Target: FXN; (+) strand; PAM type: YTN; PAM sequence: CTA
actagtttcactcccatgat

SEQ ID NO: 31188 - DNA, 20 bp, Artificial Sequence
  Description of Artificial Sequence: Synthetic oligonucleotide
  Target: FXN; (+) strand; PAM type: YTN; PAM sequence: CTA
gtttcactcccatgataacc

SEQ ID NO: 31189 - DNA, 20 bp, Artificial Sequence
  Description of Artificial Sequence: Synthetic oligonucleotide
  Target: FXN; (+) strand; PAM type: YTN; PAM sequence: TTT
cactcccatgataacccatt

SEQ ID NO: 31190 - DNA, 20 bp, Artificial Sequence
  Description of Artificial Sequence: Synthetic oligonucleotide
  Target: FXN; (+) strand; PAM type: YTN; PAM sequence: TTC
actcccatgataacccatta

SEQ ID NO: 31191 - DNA, 20 bp, Artificial Sequence
  Description of Artificial Sequence: Synthetic oligonucleotide
  Target: FXN; (+) strand; PAM type: YTN; PAM sequence: CTC
ccatgataacccattaatct

SEQ ID NO: 31192 - DNA, 20 bp, Artificial Sequence
  Description of Artificial Sequence: Synthetic oligonucleotide
  Target: FXN; (+) strand; PAM type: YTN; PAM sequence: TTA
atctatgaatggattaatcc

SEQ ID NO: 31193 - DNA, 20 bp, Artificial Sequence
  Description of Artificial Sequence: Synthetic oligonucleotide
  Target: FXN; (+) strand; PAM type: YTN; PAM sequence: CTA
tgaatggattaatccattat

SEQ ID NO: 31194 - DNA, 20 bp, Artificial Sequence
  Description of Artificial Sequence: Synthetic oligonucleotide
  Target: FXN; (+) strand; PAM type: YTN; PAM sequence: TTA
atccattattgagggaagaa

SEQ ID NO: 31195 - DNA, 20 bp, Artificial Sequence
  Description of Artificial Sequence: Synthetic oligonucleotide
  Target: FXN; (+) strand; PAM type: YTN; PAM sequence: TTA
ttgagggaagaaccttcatg

SEQ ID NO: 31196 - DNA, 20 bp, Artificial Sequence
  Description of Artificial Sequence: Synthetic oligonucleotide
  Target: FXN; (+) strand; PAM type: YTN; PAM sequence: TTG
agggaagaaccttcatgacc

SEQ ID NO: 31197 - DNA, 20 bp, Artificial Sequence
  Description of Artificial Sequence: Synthetic oligonucleotide
  Target: FXN; (+) strand; PAM type: YTN; PAM sequence: CTT
catgacccagtcaccgctta

SEQ ID NO: 31198 - DNA, 20 bp, Artificial Sequence
  Description of Artificial Sequence: Synthetic oligonucleotide
  Target: FXN; (+) strand; PAM type: YTN; PAM sequence: TTC
atgacccagtcaccgcttaa

SEQ ID NO: 31199 - DNA, 20 bp, Artificial Sequence
  Description of Artificial Sequence: Synthetic oligonucleotide
  Target: FXN; (+) strand; PAM type: YTN; PAM sequence: CTT
aaaggccccacctctcaata

SEQ ID NO: 31200 - DNA, 20 bp, Artificial Sequence
  Description of Artificial Sequence: Synthetic oligonucleotide
  Target: FXN; (+) strand; PAM type: YTN; PAM sequence: TTA
aaggccccacctctcaatac

SEQ ID NO: 31201 - DNA, 20 bp, Artificial Sequence
  Description of Artificial Sequence: Synthetic oligonucleotide
  Target: FXN; (+) strand; PAM type: YTN; PAM sequence: CTC
tcaatactgccacatcggga

SEQ ID NO: 31202 - DNA, 20 bp, Artificial Sequence
  Description of Artificial Sequence: Synthetic oligonucleotide
  Target: FXN; (+) strand; PAM type: YTN; PAM sequence: CTC
aatactgccacatcgggaat

SEQ ID NO: 31203 - DNA, 20 bp, Artificial Sequence
  Description of Artificial Sequence: Synthetic oligonucleotide
  Target: FXN; (+) strand; PAM type: YTN; PAM sequence: CTG
ccacatcgggaattaagttt

SEQ ID NO: 31204 - DNA, 20 bp, Artificial Sequence
  Description of Artificial Sequence: Synthetic oligonucleotide
  Target: FXN; (+) strand; PAM type: YTN; PAM sequence: TTA
agtttcaacatgagtttcgg

SEQ ID NO: 31205 - DNA, 20 bp, Artificial Sequence
  Description of Artificial Sequence: Synthetic oligonucleotide
  Target: FXN; (+) strand; PAM type: YTN; PAM sequence: TTT
caacatgagtttcggaggtg

SEQ ID NO: 31206 - DNA, 20 bp, Artificial Sequence
  Description of Artificial Sequence: Synthetic oligonucleotide
  Target: FXN; (+) strand; PAM type: YTN; PAM sequence: TTC
aacatgagtttcggaggtga

SEQ ID NO: 31207 - DNA, 20 bp, Artificial Sequence
  Description of Artificial Sequence: Synthetic oligonucleotide
  Target: FXN; (+) strand; PAM type: YTN; PAM sequence: TTT
cggaggtgacaaacattcaa

SEQ ID NO: 31208 - DNA, 20 bp, Artificial Sequence
  Description of Artificial Sequence: Synthetic oligonucleotide
  Target: FXN; (+) strand; PAM type: YTN; PAM sequence: TTC
ggaggtgacaaacattcaaa

SEQ ID NO: 31209 - DNA, 20 bp, Artificial Sequence
  Description of Artificial Sequence: Synthetic oligonucleotide
  Target: FXN; (+) strand; PAM type: YTN; PAM sequence: TTC
aaaccatagcatgctgtctc

SEQ ID NO: 31210 - DNA, 20 bp, Artificial Sequence
  Description of Artificial Sequence: Synthetic oligonucleotide
  Target: FXN; (+) strand; PAM type: YTN; PAM sequence: CTG
tctcttaaatgactcaataa

SEQ ID NO: 31211 - DNA, 20 bp, Artificial Sequence
  Description of Artificial Sequence: Synthetic oligonucleotide
  Target: FXN; (+) strand; PAM type: YTN; PAM sequence: CTC
ttaaatgactcaataagctc

SEQ ID NO: 31212 - DNA, 20 bp, Artificial Sequence
  Description of Artificial Sequence: Synthetic oligonucleotide
  Target: FXN; (+) strand; PAM type: YTN; PAM sequence: CTT
aaatgactcaataagctcct

SEQ ID NO: 31213 - DNA, 20 bp, Artificial Sequence
  Description of Artificial Sequence: Synthetic oligonucleotide
  Target: FXN; (+) strand; PAM type: YTN; PAM sequence: TTA
aatgactcaataagctcctg

SEQ ID NO: 31214 - DNA, 20 bp, Artificial Sequence
  Description of Artificial Sequence: Synthetic oligonucleotide
  Target: FXN; (+) strand; PAM type: YTN; PAM sequence: CTC
aataagctcctgtggcatcc

SEQ ID NO: 31215 - DNA, 20 bp, Artificial Sequence
  Description of Artificial Sequence: Synthetic oligonucleotide
  Target: FXN; (+) strand; PAM type: YTN; PAM sequence: CTC
ctgtggcatccacttctgca

SEQ ID NO: 31216 - DNA, 20 bp, Artificial Sequence
  Description of Artificial Sequence: Synthetic oligonucleotide
  Target: FXN; (+) strand; PAM type: YTN; PAM sequence: CTG
tggcatccacttctgcatgc

SEQ ID NO: 31217 - DNA, 20 bp, Artificial Sequence
  Description of Artificial Sequence: Synthetic oligonucleotide
  Target: FXN; (+) strand; PAM type: YTN; PAM sequence: CTT
ctgcatgccttgggcagctt

SEQ ID NO: 31218 - DNA, 20 bp, Artificial Sequence
  Description of Artificial Sequence: Synthetic oligonucleotide
  Target: FXN; (+) strand; PAM type: YTN; PAM sequence: TTC
tgcatgccttgggcagcttt

SEQ ID NO: 31219 - DNA, 20 bp, Artificial Sequence
  Description of Artificial Sequence: Synthetic oligonucleotide
  Target: FXN; (+) strand; PAM type: YTN; PAM sequence: CTG
catgccttgggcagctttta

SEQ ID NO: 31220 - DNA, 20 bp, Artificial Sequence
  Description of Artificial Sequence: Synthetic oligonucleotide
  Target: FXN; (+) strand; PAM type: YTN; PAM sequence: CTT
gggcagcttttagacatctg

SEQ ID NO: 31221 - DNA, 20 bp, Artificial Sequence
  Description of Artificial Sequence: Synthetic oligonucleotide
  Target: FXN; (+) strand; PAM type: YTN; PAM sequence: TTG
ggcagcttttagacatctgt

SEQ ID NO: 31222 - DNA, 20 bp, Artificial Sequence
  Description of Artificial Sequence: Synthetic oligonucleotide
  Target: FXN; (+) strand; PAM type: YTN; PAM sequence: CTT
ttagacatctgtccattttc

SEQ ID NO: 31223 - DNA, 20 bp, Artificial Sequence
  Description of Artificial Sequence: Synthetic oligonucleotide
  Target: FXN; (+) strand; PAM type: YTN; PAM sequence: TTT
tagacatctgtccattttcc

SEQ ID NO: 31224 - DNA, 20 bp, Artificial Sequence
  Description of Artificial Sequence: Synthetic oligonucleotide
  Target: FXN; (+) strand; PAM type: YTN; PAM sequence: TTT
agacatctgtccattttcct

SEQ ID NO: 31225 - DNA, 20 bp, Artificial Sequence
  Description of Artificial Sequence: Synthetic oligonucleotide
  Target: FXN; (+) strand; PAM type: YTN; PAM sequence: TTA
gacatctgtccattttccta

SEQ ID NO: 31226 - DNA, 20 bp, Artificial Sequence
  Description of Artificial Sequence: Synthetic oligonucleotide
  Target: FXN; (+) strand; PAM type: YTN; PAM sequence: CTG
tccattttcctagagggaca

SEQ ID NO: 31227 - DNA, 20 bp, Artificial Sequence
  Description of Artificial Sequence: Synthetic oligonucleotide
  Target: FXN; (+) strand; PAM type: YTN; PAM sequence: TTT
tcctagagggacaagaccac

SEQ ID NO: 31228 - DNA, 20 bp, Artificial Sequence
  Description of Artificial Sequence: Synthetic oligonucleotide
  Target: FXN; (+) strand; PAM type: YTN; PAM sequence: TTT
cctagagggacaagaccacc

SEQ ID NO: 31229 - DNA, 20 bp, Artificial Sequence
  Description of Artificial Sequence: Synthetic oligonucleotide
  Target: FXN; (+) strand; PAM type: YTN; PAM sequence: TTC
ctagagggacaagaccacca

SEQ ID NO: 31230 - DNA, 20 bp, Artificial Sequence
  Description of Artificial Sequence: Synthetic oligonucleotide
  Target: FXN; (+) strand; PAM type: YTN; PAM sequence: CTA
gagggacaagaccaccacct

SEQ ID NO: 31231 - DNA, 20 bp, Artificial Sequence
  Description of Artificial Sequence: Synthetic oligonucleotide
  Target: FXN; (+) strand; PAM type: YTN; PAM sequence: CTG
tgatcctatgaccttttggc

SEQ ID NO: 31232 - DNA, 20 bp, Artificial Sequence
  Description of Artificial Sequence: Synthetic oligonucleotide
  Target: FXN; (+) strand; PAM type: YTN; PAM sequence: CTA
tgaccttttggctttaggcc

SEQ ID NO: 31233 - DNA, 20 bp, Artificial Sequence
  Description of Artificial Sequence: Synthetic oligonucleotide
  Target: FXN; (+) strand; PAM type: YTN; PAM sequence: CTT
ttggctttaggcctaacaag

SEQ ID NO: 31234 - DNA, 20 bp, Artificial Sequence
  Description of Artificial Sequence: Synthetic oligonucleotide
  Target: FXN; (+) strand; PAM type: YTN; PAM sequence: TTT
tggctttaggcctaacaagc

SEQ ID NO: 31235 - DNA, 20 bp, Artificial Sequence
  Description of Artificial Sequence: Synthetic oligonucleotide
  Target: FXN; (+) strand; PAM type: YTN; PAM sequence: TTT
ggctttaggcctaacaagca

SEQ ID NO: 31236 - DNA, 20 bp, Artificial Sequence
  Description of Artificial Sequence: Synthetic oligonucleotide
  Target: FXN; (+) strand; PAM type: YTN; PAM sequence: TTG
gctttaggcctaacaagcag

SEQ ID NO: 31237 - DNA, 20 bp, Artificial Sequence
  Description of Artificial Sequence: Synthetic oligonucleotide
  Target: FXN; (+) strand; PAM type: YTN; PAM sequence: CTT
taggcctaacaagcaggtta

SEQ ID NO: 31238 - DNA, 20 bp, Artificial Sequence
  Description of Artificial Sequence: Synthetic oligonucleotide
  Target: FXN; (+) strand; PAM type: YTN; PAM sequence: TTT
aggcctaacaagcaggttat

SEQ ID NO: 31239 - DNA, 20 bp, Artificial Sequence
  Description of Artificial Sequence: Synthetic oligonucleotide
  Target: FXN; (+) strand; PAM type: YTN; PAM sequence: TTA
ggcctaacaagcaggttata

SEQ ID NO: 31240 - DNA, 20 bp, Artificial Sequence
  Description of Artificial Sequence: Synthetic oligonucleotide
  Target: FXN; (+) strand; PAM type: YTN; PAM sequence: CTA
acaagcaggttataccctca

SEQ ID NO: 31241 - DNA, 20 bp, Artificial Sequence
  Description of Artificial Sequence: Synthetic oligonucleotide
  Target: FXN; (+) strand; PAM type: YTN; PAM sequence: TTA
taccctcactcactttcaaa

SEQ ID NO: 31242 - DNA, 20 bp, Artificial Sequence
  Description of Artificial Sequence: Synthetic oligonucleotide
  Target: FXN; (+) strand; PAM type: YTN; PAM sequence: CTC
actcactttcaaatcatttt

SEQ ID NO: 31243 - DNA, 20 bp, Artificial Sequence
  Description of Artificial Sequence: Synthetic oligonucleotide
  Target: FXN; (+) strand; PAM type: YTN; PAM sequence: CTC
actttcaaatcatttttatt

SEQ ID NO: 31244 - DNA, 20 bp, Artificial Sequence
  Description of Artificial Sequence: Synthetic oligonucleotide
  Target: FXN; (+) strand; PAM type: YTN; PAM sequence: CTT
tcaaatcatttttattgtct

SEQ ID NO: 31245 - DNA, 20 bp, Artificial Sequence
  Description of Artificial Sequence: Synthetic oligonucleotide
  Target: FXN; (+) strand; PAM type: YTN; PAM sequence: TTT
caaatcatttttattgtctt

SEQ ID NO: 31246 - DNA, 20 bp, Artificial Sequence
  Description of Artificial Sequence: Synthetic oligonucleotide
  Target: FXN; (+) strand; PAM type: YTN; PAM sequence: TTC
aaatcatttttattgtcttg

SEQ ID NO: 31247 - DNA, 20 bp, Artificial Sequence
  Description of Artificial Sequence: Synthetic oligonucleotide
  Target: FXN; (+) strand; PAM type: YTN; PAM sequence: TTT
ttattgtcttgcagacaatt

SEQ ID NO: 31248 - DNA, 20 bp, Artificial Sequence
  Description of Artificial Sequence: Synthetic oligonucleotide
  Target: FXN; (+) strand; PAM type: YTN; PAM sequence: TTT
tattgtcttgcagacaattt

SEQ ID NO: 31249 - DNA, 20 bp, Artificial Sequence
  Description of Artificial Sequence: Synthetic oligonucleotide
  Target: FXN; (+) strand; PAM type: YTN; PAM sequence: TTT
attgtcttgcagacaattta

SEQ ID NO: 31250 - DNA, 20 bp, Artificial Sequence
  Description of Artificial Sequence: Synthetic oligonucleotide
  Target: FXN; (+) strand; PAM type: YTN; PAM sequence: TTA
ttgtcttgcagacaatttac

SEQ ID NO: 31251 - DNA, 20 bp, Artificial Sequence
  Description of Artificial Sequence: Synthetic oligonucleotide
  Target: FXN; (+) strand; PAM type: YTN; PAM sequence: TTG
tcttgcagacaatttacaca

SEQ ID NO: 31252 - DNA, 20 bp, Artificial Sequence
  Description of Artificial Sequence: Synthetic oligonucleotide
  Target: FXN; (+) strand; PAM type: YTN; PAM sequence: CTT
gcagacaatttacacaagtt

SEQ ID NO: 31253 - DNA, 20 bp, Artificial Sequence
  Description of Artificial Sequence: Synthetic oligonucleotide
  Target: FXN; (+) strand; PAM type: YTN; PAM sequence: TTG
cagacaatttacacaagttt

SEQ ID NO: 31254 - DNA, 20 bp, Artificial Sequence
  Description of Artificial Sequence: Synthetic oligonucleotide
  Target: FXN; (+) strand; PAM type: YTN; PAM sequence: TTT
acacaagtttacacatagaa

SEQ ID NO: 31255 - DNA, 20 bp, Artificial Sequence
  Description of Artificial Sequence: Synthetic oligonucleotide
  Target: FXN; (+) strand; PAM type: YTN; PAM sequence: TTA
cacaagtttacacatagaaa

SEQ ID NO: 31256 - DNA, 20 bp, Artificial Sequence
  Description of Artificial Sequence: Synthetic oligonucleotide
  Target: FXN; (+) strand; PAM type: YTN; PAM sequence: TTT
acacatagaaaaggatatgt

SEQ ID NO: 31257 - DNA, 20 bp, Artificial Sequence
  Description of Artificial Sequence: Synthetic oligonucleotide
  Target: FXN; (+) strand; PAM type: YTN; PAM sequence: TTA
cacatagaaaaggatatgta

SEQ ID NO: 31258 - DNA, 20 bp, Artificial Sequence
  Description of Artificial Sequence: Synthetic oligonucleotide
  Target: FXN; (+) strand; PAM type: YTN; PAM sequence: TTT
atacgctgccgggcgcggtg

SEQ ID NO: 31259 - DNA, 20 bp, Artificial Sequence
  Description of Artificial Sequence: Synthetic oligonucleotide
  Target: FXN; (+) strand; PAM type: YTN; PAM sequence: TTA
tacgctgccgggcgcggtgg

SEQ ID NO: 31260 - DNA, 20 bp, Artificial Sequence
  Description of Artificial Sequence: Synthetic oligonucleotide
  Target: FXN; (+) strand; PAM type: YTN; PAM sequence: CTG
ccgggcgcggtggctcacgc

SEQ ID NO: 31261 - DNA, 20 bp, Artificial Sequence
  Description of Artificial Sequence: Synthetic oligonucleotide
  Target: FXN; (+) strand; PAM type: YTN; PAM sequence: CTC
acgcctgtaatcccagcact

SEQ ID NO: 31262 - DNA, 20 bp, Artificial Sequence
  Description of Artificial Sequence: Synthetic oligonucleotide
  Target: FXN; (+) strand; PAM type: YTN; PAM sequence: CTG
taatcccagcactttgggag

SEQ ID NO: 31263 - DNA, 20 bp, Artificial Sequence
  Description of Artificial Sequence: Synthetic oligonucleotide
  Target: FXN; (+) strand; PAM type: YTN; PAM sequence: CTT
tgggaggccgaggcaggtgg

SEQ ID NO: 31264 - DNA, 20 bp, Artificial Sequence
  Description of Artificial Sequence: Synthetic oligonucleotide
  Target: FXN; (+) strand; PAM type: YTN; PAM sequence: TTT
gggaggccgaggcaggtgga

SEQ ID NO: 31265 - DNA, 20 bp, Artificial Sequence
  Description of Artificial Sequence: Synthetic oligonucleotide
  Target: FXN; (+) strand; PAM type: YTN; PAM sequence: TTG
ggaggccgaggcaggtggat

SEQ ID NO: 31266 - DNA, 20 bp, Artificial Sequence
  Description of Artificial Sequence: Synthetic oligonucleotide
  Target: FXN; (+) strand; PAM type: YTN; PAM sequence: TTC
aggagatggagaccatcctg

SEQ ID NO: 31267 - DNA, 20 bp, Artificial Sequence
  Description of Artificial Sequence: Synthetic oligonucleotide
  Target: FXN; (+) strand; PAM type: YTN; PAM sequence: CTG
gctaatacgatgaaacccca

SEQ ID NO: 31268 - DNA, 20 bp, Artificial Sequence
  Description of Artificial Sequence: Synthetic oligonucleotide
  Target: FXN; (+) strand; PAM type: YTN; PAM sequence: CTA
atacgatgaaaccccatctc

SEQ ID NO: 31269 - DNA, 20 bp, Artificial Sequence
  Description of Artificial Sequence: Synthetic oligonucleotide
  Target: FXN; (+) strand; PAM type: YTN; PAM sequence: CTC
tactaaaaatacaaaaaatt

SEQ ID NO: 31270 - DNA, 20 bp, Artificial Sequence
  Description of Artificial Sequence: Synthetic oligonucleotide
  Target: FXN; (+) strand; PAM type: YTN; PAM sequence: CTA
ctaaaaatacaaaaaattag

SEQ ID NO: 31271 - DNA, 20 bp, Artificial Sequence
  Description of Artificial Sequence: Synthetic oligonucleotide
  Target: FXN; (+) strand; PAM type: YTN; PAM sequence: CTA
aaaatacaaaaaattagccg

SEQ ID NO: 31272 - DNA, 20 bp, Artificial Sequence
  Description of Artificial Sequence: Synthetic oligonucleotide
  Target: FXN; (+) strand; PAM type: YTN; PAM sequence: TTA
gccgggcgtggtgacgggtg

SEQ ID NO: 31273 - DNA, 20 bp, Artificial Sequence
  Description of Artificial Sequence: Synthetic oligonucleotide
  Target: FXN; (+) strand; PAM type: YTN; PAM sequence: CTG
tagtccccactactcgggac

SEQ ID NO: 31274 - DNA, 20 bp, Artificial Sequence
  Description of Artificial Sequence: Synthetic oligonucleotide
  Target: FXN; (+) strand; PAM type: YTN; PAM sequence: CTA
ctcgggacgctgaggcagga

SEQ ID NO: 31275 - DNA, 20 bp, Artificial Sequence
  Description of Artificial Sequence: Synthetic oligonucleotide
  Target: FXN; (+) strand; PAM type: YTN; PAM sequence: CTC
gggacgctgaggcaggagaa

SEQ ID NO: 31276 - DNA, 20 bp, Artificial Sequence
  Description of Artificial Sequence: Synthetic oligonucleotide
  Target: FXN; (+) strand; PAM type: YTN; PAM sequence: CTG
aggcaggagaatggcgtgaa

SEQ ID NO: 31277 - DNA, 20 bp, Artificial Sequence
  Description of Artificial Sequence: Synthetic oligonucleotide
  Target: FXN; (+) strand; PAM type: YTN; PAM sequence: CTT
gcagtgatccgagatcgtgc

SEQ ID NO: 31278 - DNA, 20 bp, Artificial Sequence
  Description of Artificial Sequence: Synthetic oligonucleotide
  Target: FXN; (+) strand; PAM type: YTN; PAM sequence: TTG
cagtgatccgagatcgtgcc

SEQ ID NO: 31279 - DNA, 20 bp, Artificial Sequence
  Description of Artificial Sequence: Synthetic oligonucleotide
  Target: FXN; (+) strand; PAM type: YTN; PAM sequence: CTG
cactccagcctgggtgacag

SEQ ID NO: 31280 - DNA, 20 bp, Artificial Sequence
  Description of Artificial Sequence: Synthetic oligonucleotide
  Target: FXN; (+) strand; PAM type: YTN; PAM sequence: CTC
cagcctgggtgacagagcga

SEQ ID NO: 31281 - DNA, 20 bp, Artificial Sequence
  Description of Artificial Sequence: Synthetic oligonucleotide
  Target: FXN; (+) strand; PAM type: YTN; PAM sequence: CTG
ggtgacagagcgagactgca

SEQ ID NO: 31282 - DNA, 20 bp, Artificial Sequence
  Description of Artificial Sequence: Synthetic oligonucleotide
  Target: FXN; (+) strand; PAM type: YTN; PAM sequence: CTG
catctcaaagaaaaaaataa

SEQ ID NO: 31283 - DNA, 20 bp, Artificial Sequence
  Description of Artificial Sequence: Synthetic oligonucleotide
  Target: FXN; (+) strand; PAM type: YTN; PAM sequence: CTC
aaagaaaaaaataaataaat

SEQ ID NO: 31284 - DNA, 20 bp, Artificial Sequence
  Description of Artificial Sequence: Synthetic oligonucleotide
  Target: FXN; (+) strand; PAM type: YTN; PAM sequence: TTT
atactgcttataaactaata

SEQ ID NO: 31285 - DNA, 20 bp, Artificial Sequence
  Description of Artificial Sequence: Synthetic oligonucleotide
  Target: FXN; (+) strand; PAM type: YTN; PAM sequence: TTA
tactgcttataaactaataa

SEQ ID NO: 31286 - DNA, 20 bp, Artificial Sequence
  Description of Artificial Sequence: Synthetic oligonucleotide
  Target: FXN; (+) strand; PAM type: YTN; PAM sequence: CTG
cttataaactaataataaat

SEQ ID NO: 31287 - DNA, 20 bp, Artificial Sequence
  Description of Artificial Sequence: Synthetic oligonucleotide
  Target: FXN; (+) strand; PAM type: YTN; PAM sequence: CTT
ataaactaataataaatgct

SEQ ID NO: 31288 - DNA, 20 bp, Artificial Sequence
  Description of Artificial Sequence: Synthetic oligonucleotide
  Target: FXN; (+) strand; PAM type: YTN; PAM sequence: TTA
taaactaataataaatgcta

SEQ ID NO: 31289 - DNA, 20 bp, Artificial Sequence
  Description of Artificial Sequence: Synthetic oligonucleotide
  Target: FXN; (+) strand; PAM type: YTN; PAM sequence: CTA
ataataaatgctatggtctg

SEQ ID NO: 31290 - DNA, 20 bp, Artificial Sequence
  Description of Artificial Sequence: Synthetic oligonucleotide
  Target: FXN; (+) strand; PAM type: YTN; PAM sequence: CTA
tggtctgcatgtttgtgtca

SEQ ID NO: 31291 - DNA, 20 bp, Artificial Sequence
  Description of Artificial Sequence: Synthetic oligonucleotide
  Target: FXN; (+) strand; PAM type: YTN; PAM sequence: CTG
catgtttgtgtcaccccacc

SEQ ID NO: 31292 - DNA, 20 bp, Artificial Sequence
  Description of Artificial Sequence: Synthetic oligonucleotide
  Target: FXN; (+) strand; PAM type: YTN; PAM sequence: TTT
gtgtcaccccaccattcata

SEQ ID NO: 31293 - DNA, 20 bp, Artificial Sequence
  Description of Artificial Sequence: Synthetic oligonucleotide
  Target: FXN; (+) strand; PAM type: YTN; PAM sequence: TTG
tgtcaccccaccattcatat

SEQ ID NO: 31294 - DNA, 20 bp, Artificial Sequence
  Description of Artificial Sequence: Synthetic oligonucleotide
  Target: FXN; (+) strand; PAM type: YTN; PAM sequence: TTC
atatgttaaaacctaatcac

SEQ ID NO: 31295 - DNA, 20 bp, Artificial Sequence
  Description of Artificial Sequence: Synthetic oligonucleotide
  Target: FXN; (+) strand; PAM type: YTN; PAM sequence: TTA
aaacctaatcaccaaagtga

SEQ ID NO: 31296 - DNA, 20 bp, Artificial Sequence
  Description of Artificial Sequence: Synthetic oligonucleotide
  Target: FXN; (+) strand; PAM type: YTN; PAM sequence: CTA
atcaccaaagtgatattagg

SEQ ID NO: 31297 - DNA, 20 bp, Artificial Sequence
  Description of Artificial Sequence: Synthetic oligonucleotide
  Target: FXN; (+) strand; PAM type: YTN; PAM sequence: TTA
ggaggtggggcccttgggag

SEQ ID NO: 31298 - DNA, 20 bp, Artificial Sequence
  Description of Artificial Sequence: Synthetic oligonucleotide
  Target: FXN; (+) strand; PAM type: YTN; PAM sequence: CTT
gggaggtgatgaggtatgag

SEQ ID NO: 31299 - DNA, 20 bp, Artificial Sequence
  Description of Artificial Sequence: Synthetic oligonucleotide
  Target: FXN; (+) strand; PAM type: YTN; PAM sequence: TTG
ggaggtgatgaggtatgagg

SEQ ID NO: 31300 - DNA, 20 bp, Artificial Sequence
  Description of Artificial Sequence: Synthetic oligonucleotide
  Target: FXN; (+) strand; PAM type: YTN; PAM sequence: TTG
ggattagtgcccttctaaaa

SEQ ID NO: 31301 - DNA, 20 bp, Artificial Sequence
  Description of Artificial Sequence: Synthetic oligonucleotide
  Target: FXN; (+) strand; PAM type: YTN; PAM sequence: TTA
gtgcccttctaaaatagccc

SEQ ID NO: 31302 - DNA, 20 bp, Artificial Sequence
  Description of Artificial Sequence: Synthetic oligonucleotide
  Target: FXN; (+) strand; PAM type: YTN; PAM sequence: CTT
ctaaaatagcccaacggagc

SEQ ID NO: 31303 - DNA, 20 bp, Artificial Sequence
  Description of Artificial Sequence: Synthetic oligonucleotide
  Target: FXN; (+) strand; PAM type: YTN; PAM sequence: TTC
taaaatagcccaacggagcc

SEQ ID NO: 31304 - DNA, 20 bp, Artificial Sequence
  Description of Artificial Sequence: Synthetic oligonucleotide
  Target: FXN; (+) strand; PAM type: YTN; PAM sequence: CTA
aaatagcccaacggagccca

SEQ ID NO: 31305 - DNA, 20 bp, Artificial Sequence
  Description of Artificial Sequence: Synthetic oligonucleotide
  Target: FXN; (+) strand; PAM type: YTN; PAM sequence: CTA
tgaaccaggaaactggccct

SEQ ID NO: 31306 - DNA, 20 bp, Artificial Sequence
  Description of Artificial Sequence: Synthetic oligonucleotide
  Target: FXN; (+) strand; PAM type: YTN; PAM sequence: CTG
gccctcaccagacaccaaag

SEQ ID NO: 31307 - DNA, 20 bp, Artificial Sequence
  Description of Artificial Sequence: Synthetic oligonucleotide
  Target: FXN; (+) strand; PAM type: YTN; PAM sequence: CTC
accagacaccaaagctgttg

SEQ ID NO: 31308 - DNA, 20 bp, Artificial Sequence
  Description of Artificial Sequence: Synthetic oligonucleotide
  Target: FXN; (+) strand; PAM type: YTN; PAM sequence: CTG
ttggtgcattgatcttggat

SEQ ID NO: 31309 - DNA, 20 bp, Artificial Sequence
  Description of Artificial Sequence: Synthetic oligonucleotide
  Target: FXN; (+) strand; PAM type: YTN; PAM sequence: TTG
gtgcattgatcttggatttc

SEQ ID NO: 31310 - DNA, 20 bp, Artificial Sequence
  Description of Artificial Sequence: Synthetic oligonucleotide
  Target: FXN; (+) strand; PAM type: YTN; PAM sequence: TTG
atcttggatttcccaccctc

SEQ ID NO: 31311 - DNA, 20 bp, Artificial Sequence
  Description of Artificial Sequence: Synthetic oligonucleotide
  Target: FXN; (+) strand; PAM type: YTN; PAM sequence: CTT
ggatttcccaccctccagga

SEQ ID NO: 31312 - DNA, 20 bp, Artificial Sequence
  Description of Artificial Sequence: Synthetic oligonucleotide
  Target: FXN; (+) strand; PAM type: YTN; PAM sequence: TTG
gatttcccaccctccaggac

SEQ ID NO: 31313 - DNA, 20 bp, Artificial Sequence
  Description of Artificial Sequence: Synthetic oligonucleotide
  Target: FXN; (+) strand; PAM type: YTN; PAM sequence: TTT
cccaccctccaggactctaa

SEQ ID NO: 31314 - DNA, 20 bp, Artificial Sequence
  Description of Artificial Sequence: Synthetic oligonucleotide
  Target: FXN; (+) strand; PAM type: YTN; PAM sequence: TTC
ccaccctccaggactctaag

SEQ ID NO: 31315 - DNA, 20 bp, Artificial Sequence
  Description of Artificial Sequence: Synthetic oligonucleotide
  Target: FXN; (+) strand; PAM type: YTN; PAM sequence: CTC
caggactctaagaaacacat

SEQ ID NO: 31316 - DNA, 20 bp, Artificial Sequence
  Description of Artificial Sequence: Synthetic oligonucleotide
  Target: FXN; (+) strand; PAM type: YTN; PAM sequence: CTC
taagaaacacatttctattg

SEQ ID NO: 31317 - DNA, 20 bp, Artificial Sequence
  Description of Artificial Sequence: Synthetic oligonucleotide
  Target: FXN; (+) strand; PAM type: YTN; PAM sequence: CTA
agaaacacatttctattgtt

SEQ ID NO: 31318 - DNA, 20 bp, Artificial Sequence
  Description of Artificial Sequence: Synthetic oligonucleotide
  Target: FXN; (+) strand; PAM type: YTN; PAM sequence: TTT
ctattgtttataagccaccc

SEQ ID NO: 31319 - DNA, 20 bp, Artificial Sequence
  Description of Artificial Sequence: Synthetic oligonucleotide
  Target: FXN; (+) strand; PAM type: YTN; PAM sequence: TTC
tattgtttataagccaccca

SEQ ID NO: 31320 - DNA, 20 bp, Artificial Sequence
  Description of Artificial Sequence: Synthetic oligonucleotide
  Target: FXN; (+) strand; PAM type: YTN; PAM sequence: CTA
ttgtttataagccacccagt

SEQ ID NO: 31321 - DNA, 20 bp, Artificial Sequence
  Description of Artificial Sequence: Synthetic oligonucleotide
  Target: FXN; (+) strand; PAM type: YTN; PAM sequence: TTG
tttataagccacccagtggc

SEQ ID NO: 31322 - DNA, 20 bp, Artificial Sequence
  Description of Artificial Sequence: Synthetic oligonucleotide
  Target: FXN; (+) strand; PAM type: YTN; PAM sequence: TTT
ataagccacccagtggctgg

SEQ ID NO: 31323 - DNA, 20 bp, Artificial Sequence
  Description of Artificial Sequence: Synthetic oligonucleotide
  Target: FXN; (+) strand; PAM type: YTN; PAM sequence: TTA
taagccacccagtggctggt

SEQ ID NO: 31324 - DNA, 20 bp, Artificial Sequence
  Description of Artificial Sequence: Synthetic oligonucleotide
  Target: FXN; (+) strand; PAM type: YTN; PAM sequence: CTG
gtattttgttataacatccc

SEQ ID NO: 31325 - DNA, 20 bp, Artificial Sequence
  Description of Artificial Sequence: Synthetic oligonucleotide
  Target: FXN; (+) strand; PAM type: YTN; PAM sequence: TTT
tgttataacatcccagacta

SEQ ID NO: 31326 - DNA, 20 bp, Artificial Sequence
  Description of Artificial Sequence: Synthetic oligonucleotide
  Target: FXN; (+) strand; PAM type: YTN; PAM sequence: TTT
gttataacatcccagactaa

SEQ ID NO: 31327 - DNA, 20 bp, Artificial Sequence
  Description of Artificial Sequence: Synthetic oligonucleotide
  Target: FXN; (+) strand; PAM type: YTN; PAM sequence: TTG
ttataacatcccagactaag

SEQ ID NO: 31328 - DNA, 20 bp, Artificial Sequence
  Description of Artificial Sequence: Synthetic oligonucleotide
  Target: FXN; (+) strand; PAM type: YTN; PAM sequence: TTA
taacatcccagactaagaca

SEQ ID NO: 31329 - DNA, 20 bp, Artificial Sequence
  Description of Artificial Sequence: Synthetic oligonucleotide
  Target: FXN; (+) strand; PAM type: YTN; PAM sequence: CTA
agacaaataacaaatacttg

SEQ ID NO: 31330 - DNA, 20 bp, Artificial Sequence
  Description of Artificial Sequence: Synthetic oligonucleotide
  Target: FXN; (+) strand; PAM type: YTN; PAM sequence: CTT
gtatccctgacaccaggtta

SEQ ID NO: 31331 - DNA, 20 bp, Artificial Sequence
  Description of Artificial Sequence: Synthetic oligonucleotide
  Target: FXN; (+) strand; PAM type: YTN; PAM sequence: TTG
tatccctgacaccaggttaa

SEQ ID NO: 31332 - DNA, 20 bp, Artificial Sequence
  Description of Artificial Sequence: Synthetic oligonucleotide
  Target: FXN; (+) strand; PAM type: YTN; PAM sequence: CTG
acaccaggttaagagataga

SEQ ID NO: 31333 - DNA, 20 bp, Artificial Sequence
  Description of Artificial Sequence: Synthetic oligonucleotide
  Target: FXN; (+) strand; PAM type: YTN; PAM sequence: TTA
agagatagaatttgtttgtt

SEQ ID NO: 31334 - DNA, 20 bp, Artificial Sequence
  Description of Artificial Sequence: Synthetic oligonucleotide
  Target: FXN; (+) strand; PAM type: YTN; PAM sequence: TTT
gtttgttcctctggaggccc

SEQ ID NO: 31335 - DNA, 20 bp, Artificial Sequence
  Description of Artificial Sequence: Synthetic oligonucleotide
  Target: FXN; (+) strand; PAM type: YTN; PAM sequence: TTG
tttgttcctctggaggccct

SEQ ID NO: 31336 - DNA, 20 bp, Artificial Sequence
  Description of Artificial Sequence: Synthetic oligonucleotide
  Target: FXN; (+) strand; PAM type: YTN; PAM sequence: TTT
gttcctctggaggcccttgt

SEQ ID NO: 31337 - DNA, 20 bp, Artificial Sequence
  Description of Artificial Sequence: Synthetic oligonucleotide
  Target: FXN; (+) strand; PAM type: YTN; PAM sequence: TTG
ttcctctggaggcccttgtc

SEQ ID NO: 31338 - DNA, 20 bp, Artificial Sequence
  Description of Artificial Sequence: Synthetic oligonucleotide
  Target: FXN; (+) strand; PAM type: YTN; PAM sequence: TTC
ctctggaggcccttgtcttc

SEQ ID NO: 31339 - DNA, 20 bp, Artificial Sequence
  Description of Artificial Sequence: Synthetic oligonucleotide
  Target: FXN; (+) strand; PAM type: YTN; PAM sequence: CTC
tggaggcccttgtcttcacc

SEQ ID NO: 31340 - DNA, 20 bp, Artificial Sequence
  Description of Artificial Sequence: Synthetic oligonucleotide
  Target: FXN; (+) strand; PAM type: YTN; PAM sequence: CTG
gaggcccttgtcttcacccc

SEQ ID NO: 31341 - DNA, 20 bp, Artificial Sequence
  Description of Artificial Sequence: Synthetic oligonucleotide
  Target: FXN; (+) strand; PAM type: YTN; PAM sequence: CTT
gtcttcaccccatcactgcc

SEQ ID NO: 31342 - DNA, 20 bp, Artificial Sequence
  Description of Artificial Sequence: Synthetic oligonucleotide
  Target: FXN; (+) strand; PAM type: YTN; PAM sequence: TTG
tcttcaccccatcactgccc

SEQ ID NO: 31343 - DNA, 20 bp, Artificial Sequence
  Description of Artificial Sequence: Synthetic oligonucleotide
  Target: FXN; (+) strand; PAM type: YTN; PAM sequence: CTT
caccccatcactgccctgtc

SEQ ID NO: 31344 - DNA, 20 bp, Artificial Sequence
  Description of Artificial Sequence: Synthetic oligonucleotide
  Target: FXN; (+) strand; PAM type: YTN; PAM sequence: TTC
accccatcactgccctgtcc

SEQ ID NO: 31345 - DNA, 20 bp, Artificial Sequence
  Description of Artificial Sequence: Synthetic oligonucleotide
  Target: FXN; (+) strand; PAM type: YTN; PAM sequence: CTG
ccctgtcctccctggaggaa

SEQ ID NO: 31346 - DNA, 20 bp, Artificial Sequence
  Description of Artificial Sequence: Synthetic oligonucleotide
  Target: FXN; (+) strand; PAM type: YTN; PAM sequence: CTG
tcctccctggaggaatctgc

SEQ ID NO: 31347 - DNA, 20 bp, Artificial Sequence
  Description of Artificial Sequence: Synthetic oligonucleotide
  Target: FXN; (+) strand; PAM type: YTN; PAM sequence: CTC
cctggaggaatctgccagcc

SEQ ID NO: 31348 - DNA, 20 bp, Artificial Sequence
  Description of Artificial Sequence: Synthetic oligonucleotide
  Target: FXN; (+) strand; PAM type: YTN; PAM sequence: CTG
gaggaatctgccagcccgaa

SEQ ID NO: 31349 - DNA, 20 bp, Artificial Sequence
  Description of Artificial Sequence: Synthetic oligonucleotide
  Target: FXN; (+) strand; PAM type: YTN; PAM sequence: CTG
ccagcccgaattctgttcat

SEQ ID NO: 31350 - DNA, 20 bp, Artificial Sequence
  Description of Artificial Sequence: Synthetic oligonucleotide
  Target: FXN; (+) strand; PAM type: YTN; PAM sequence: TTC
tgttcatcgtaccctccttt

SEQ ID NO: 31351 - DNA, 20 bp, Artificial Sequence
  Description of Artificial Sequence: Synthetic oligonucleotide
  Target: FXN; (+) strand; PAM type: YTN; PAM sequence: CTG
ttcatcgtaccctccttttc

SEQ ID NO: 31352 - DNA, 20 bp, Artificial Sequence
  Description of Artificial Sequence: Synthetic oligonucleotide
  Target: FXN; (+) strand; PAM type: YTN; PAM sequence: TTC
atcgtaccctccttttctta

SEQ ID NO: 31353 - DNA, 20 bp, Artificial Sequence
  Description of Artificial Sequence: Synthetic oligonucleotide
  Target: FXN; (+) strand; PAM type: YTN; PAM sequence: CTC
cttttcttagagtttgacct

SEQ ID NO: 31354 - DNA, 20 bp, Artificial Sequence
  Description of Artificial Sequence: Synthetic oligonucleotide
  Target: FXN; (+) strand; PAM type: YTN; PAM sequence: CTT
ttcttagagtttgacctcct

SEQ ID NO: 31355 - DNA, 20 bp, Artificial Sequence
  Description of Artificial Sequence: Synthetic oligonucleotide
  Target: FXN; (+) strand; PAM type: YTN; PAM sequence: TTT
tcttagagtttgacctcctc

SEQ ID NO: 31356 - DNA, 20 bp, Artificial Sequence
  Description of Artificial Sequence: Synthetic oligonucleotide
  Target: FXN; (+) strand; PAM type: YTN; PAM sequence: TTT
cttagagtttgacctcctct

SEQ ID NO: 31357 - DNA, 20 bp, Artificial Sequence
  Description of Artificial Sequence: Synthetic oligonucleotide
  Target: FXN; (+) strand; PAM type: YTN; PAM sequence: TTC
ttagagtttgacctcctctg

SEQ ID NO: 31358 - DNA, 20 bp, Artificial Sequence
  Description of Artificial Sequence: Synthetic oligonucleotide
  Target: FXN; (+) strand; PAM type: YTN; PAM sequence: CTT
agagtttgacctcctctgta

SEQ ID NO: 31359 - DNA, 20 bp, Artificial Sequence
  Description of Artificial Sequence: Synthetic oligonucleotide
  Target: FXN; (+) strand; PAM type: YTN; PAM sequence: TTA
gagtttgacctcctctgtat

SEQ ID NO: 31360 - DNA, 20 bp, Artificial Sequence
  Description of Artificial Sequence: Synthetic oligonucleotide
  Target: FXN; (+) strand; PAM type: YTN; PAM sequence: TTT
gacctcctctgtatctcccc

SEQ ID NO: 31361 - DNA, 20 bp, Artificial Sequence
  Description of Artificial Sequence: Synthetic oligonucleotide
  Target: FXN; (+) strand; PAM type: YTN; PAM sequence: TTG
acctcctctgtatctccccc

SEQ ID NO: 31362 - DNA, 20 bp, Artificial Sequence
  Description of Artificial Sequence: Synthetic oligonucleotide
  Target: FXN; (+) strand; PAM type: YTN; PAM sequence: CTC
ctctgtatctcccccaatcc

SEQ ID NO: 31363 - DNA, 20 bp, Artificial Sequence
  Description of Artificial Sequence: Synthetic oligonucleotide
  Target: FXN; (+) strand; PAM type: YTN; PAM sequence: CTC
tgtatctcccccaatccatg

SEQ ID NO: 31364 - DNA, 20 bp, Artificial Sequence
  Description of Artificial Sequence: Synthetic oligonucleotide
  Target: FXN; (+) strand; PAM type: YTN; PAM sequence: CTG
tatctcccccaatccatgta

SEQ ID NO: 31365 - DNA, 20 bp, Artificial Sequence
  Description of Artificial Sequence: Synthetic oligonucleotide
  Target: FXN; (+) strand; PAM type: YTN; PAM sequence: CTC
ccccaatccatgtattgctt

SEQ ID NO: 31366 - DNA, 20 bp, Artificial Sequence
  Description of Artificial Sequence: Synthetic oligonucleotide
  Target: FXN; (+) strand; PAM type: YTN; PAM sequence: TTG
cttatatacaaggtattctg

SEQ ID NO: 31367 - DNA, 20 bp, Artificial Sequence
  Description of Artificial Sequence: Synthetic oligonucleotide
  Target: FXN; (+) strand; PAM type: YTN; PAM sequence: CTT
atatacaaggtattctgctg

SEQ ID NO: 31368 - DNA, 20 bp, Artificial Sequence
  Description of Artificial Sequence: Synthetic oligonucleotide
  Target: FXN; (+) strand; PAM type: YTN; PAM sequence: TTA
tatacaaggtattctgctgt

SEQ ID NO: 31369 - DNA, 20 bp, Artificial Sequence
  Description of Artificial Sequence: Synthetic oligonucleotide
  Target: FXN; (+) strand; PAM type: YTN; PAM sequence: TTC
tgctgtatctgttctgctat

SEQ ID NO: 31370 - DNA, 20 bp, Artificial Sequence
  Description of Artificial Sequence: Synthetic oligonucleotide
  Target: FXN; (+) strand; PAM type: YTN; PAM sequence: CTG
ctgtatctgttctgctatgg

SEQ ID NO: 31371 - DNA, 20 bp, Artificial Sequence
  Description of Artificial Sequence: Synthetic oligonucleotide
  Target: FXN; (+) strand; PAM type: YTN; PAM sequence: CTG
tatctgttctgctatggctt

SEQ ID NO: 31372 - DNA, 20 bp, Artificial Sequence
  Description of Artificial Sequence: Synthetic oligonucleotide
  Target: FXN; (+) strand; PAM type: YTN; PAM sequence: CTG
ttctgctatggcttgcccct

SEQ ID NO: 31373 - DNA, 20 bp, Artificial Sequence
  Description of Artificial Sequence: Synthetic oligonucleotide
  Target: FXN; (+) strand; PAM type: YTN; PAM sequence: TTC
tgctatggcttgcccctttt

SEQ ID NO: 31374 - DNA, 20 bp, Artificial Sequence
  Description of Artificial Sequence: Synthetic oligonucleotide
  Target: FXN; (+) strand; PAM type: YTN; PAM sequence: CTG
ctatggcttgccccttttgt

SEQ ID NO: 31375 - DNA, 20 bp, Artificial Sequence
  Description of Artificial Sequence: Synthetic oligonucleotide
  Target: FXN; (+) strand; PAM type: YTN; PAM sequence: CTA
tggcttgccccttttgttca

SEQ ID NO: 31376 - DNA, 20 bp, Artificial Sequence
  Description of Artificial Sequence: Synthetic oligonucleotide
  Target: FXN; (+) strand; PAM type: YTN; PAM sequence: CTT
gccccttttgttcaacactg

SEQ ID NO: 31377 - DNA, 20 bp, Artificial Sequence
  Description of Artificial Sequence: Synthetic oligonucleotide
  Target: FXN; (+) strand; PAM type: YTN; PAM sequence: TTG
ccccttttgttcaacactgt

SEQ ID NO: 31378 - DNA, 20 bp, Artificial Sequence
  Description of Artificial Sequence: Synthetic oligonucleotide
  Target: FXN; (+) strand; PAM type: YTN; PAM sequence: CTT
ttgttcaacactgtttttgt

SEQ ID NO: 31379 - DNA, 20 bp, Artificial Sequence
  Description of Artificial Sequence: Synthetic oligonucleotide
  Target: FXN; (+) strand; PAM type: YTN; PAM sequence: TTT
tgttcaacactgtttttgtg

SEQ ID NO: 31380 - DNA, 20 bp, Artificial Sequence
  Description of Artificial Sequence: Synthetic oligonucleotide
  Target: FXN; (+) strand; PAM type: YTN; PAM sequence: TTT
gttcaacactgtttttgtgc

SEQ ID NO: 31381 - DNA, 20 bp, Artificial Sequence
  Description of Artificial Sequence: Synthetic oligonucleotide
  Target: FXN; (+) strand; PAM type: YTN; PAM sequence: TTG
ttcaacactgtttttgtgcg

SEQ ID NO: 31382 - DNA, 20 bp, Artificial Sequence
  Description of Artificial Sequence: Synthetic oligonucleotide
  Target: FXN; (+) strand; PAM type: YTN; PAM sequence: TTC
aacactgtttttgtgcgtca

SEQ ID NO: 31383 - DNA, 20 bp, Artificial Sequence
  Description of Artificial Sequence: Synthetic oligonucleotide
  Target: FXN; (+) strand; PAM type: YTN; PAM sequence: CTG
tttttgtgcgtcatctgcat

SEQ ID NO: 31384 - DNA, 20 bp, Artificial Sequence
  Description of Artificial Sequence: Synthetic oligonucleotide
  Target: FXN; (+) strand; PAM type: YTN; PAM sequence: TTT
ttgtgcgtcatctgcattga

SEQ ID NO: 31385 - DNA, 20 bp, Artificial Sequence
  Description of Artificial Sequence: Synthetic oligonucleotide
  Target: FXN; (+) strand; PAM type: YTN; PAM sequence: TTT
tgtgcgtcatctgcattgat

SEQ ID NO: 31386 - DNA, 20 bp, Artificial Sequence
  Description of Artificial Sequence: Synthetic oligonucleotide
  Target: FXN; (+) strand; PAM type: YTN; PAM sequence: TTT
gtgcgtcatctgcattgatg

SEQ ID NO: 31387 - DNA, 20 bp, Artificial Sequence
  Description of Artificial Sequence: Synthetic oligonucleotide
  Target: FXN; (+) strand; PAM type: YTN; PAM sequence: TTG
tgcgtcatctgcattgatgc

SEQ ID NO: 31388 - DNA, 20 bp, Artificial Sequence
  Description of Artificial Sequence: Synthetic oligonucleotide
  Target: FXN; (+) strand; PAM type: YTN; PAM sequence: CTG
cattgatgcatgcagttgtc

SEQ ID NO: 31389 - DNA, 20 bp, Artificial Sequence
  Description of Artificial Sequence: Synthetic oligonucleotide
  Target: FXN; (+) strand; PAM type: YTN; PAM sequence: TTG
atgcatgcagttgtccttta

SEQ ID NO: 31390 - DNA, 20 bp, Artificial Sequence
  Description of Artificial Sequence: Synthetic oligonucleotide
  Target: FXN; (+) strand; PAM type: YTN; PAM sequence: TTG
tcctttatttgttctcactg

SEQ ID NO: 31391 - DNA, 20 bp, Artificial Sequence
  Description of Artificial Sequence: Synthetic oligonucleotide
  Target: FXN; (+) strand; PAM type: YTN; PAM sequence: CTT
tatttgttctcactgctgga

SEQ ID NO: 31392 - DNA, 20 bp, Artificial Sequence
  Description of Artificial Sequence: Synthetic oligonucleotide
  Target: FXN; (+) strand; PAM type: YTN; PAM sequence: TTT
atttgttctcactgctggat

SEQ ID NO: 31393 - DNA, 20 bp, Artificial Sequence
  Description of Artificial Sequence: Synthetic oligonucleotide
  Target: FXN; (+) strand; PAM type: YTN; PAM sequence: TTA
tttgttctcactgctggata

SEQ ID NO: 31394 - DNA, 20 bp, Artificial Sequence
  Description of Artificial Sequence: Synthetic oligonucleotide
  Target: FXN; (+) strand; PAM type: YTN; PAM sequence: TTT
gttctcactgctggatagta

SEQ ID NO: 31395 - DNA, 20 bp, Artificial Sequence
  Description of Artificial Sequence: Synthetic oligonucleotide
  Target: FXN; (+) strand; PAM type: YTN; PAM sequence: TTG
ttctcactgctggatagtat

SEQ ID NO: 31396 - DNA, 20 bp, Artificial Sequence
  Description of Artificial Sequence: Synthetic oligonucleotide
  Target: FXN; (+) strand; PAM type: YTN; PAM sequence: TTC
tcactgctggatagtatctg

SEQ ID NO: 31397 - DNA, 20 bp, Artificial Sequence
  Description of Artificial Sequence: Synthetic oligonucleotide
  Target: FXN; (+) strand; PAM type: YTN; PAM sequence: CTC
actgctggatagtatctggt

SEQ ID NO: 31398 - DNA, 20 bp, Artificial Sequence
  Description of Artificial Sequence: Synthetic oligonucleotide
  Target: FXN; (+) strand; PAM type: YTN; PAM sequence: CTG
ctggatagtatctggttggg

SEQ ID NO: 31399 - DNA, 20 bp, Artificial Sequence
  Description of Artificial Sequence: Synthetic oligonucleotide
  Target: FXN; (+) strand; PAM type: YTN; PAM sequence: CTG
gatagtatctggttgggtaa

SEQ ID NO: 31400 - DNA, 20 bp, Artificial Sequence
  Description of Artificial Sequence: Synthetic oligonucleotide
  Target: FXN; (+) strand; PAM type: YTN; PAM sequence: CTG
gttgggtaaatatatcacac

SEQ ID NO: 31401 - DNA, 20 bp, Artificial Sequence
  Description of Artificial Sequence: Synthetic oligonucleotide
  Target: FXN; (+) strand; PAM type: YTN; PAM sequence: TTG
ggtaaatatatcacactgta

SEQ ID NO: 31402 - DNA, 20 bp, Artificial Sequence
  Description of Artificial Sequence: Synthetic oligonucleotide
  Target: FXN; (+) strand; PAM type: YTN; PAM sequence: CTG
taaatcacactatccaggtt

SEQ ID NO: 31403 - DNA, 20 bp, Artificial Sequence
  Description of Artificial Sequence: Synthetic oligonucleotide
  Target: FXN; (+) strand; PAM type: YTN; PAM sequence: CTA
tccaggttcctttaggtgac

SEQ ID NO: 31404 - DNA, 20 bp, Artificial Sequence
  Description of Artificial Sequence: Synthetic oligonucleotide
  Target: FXN; (+) strand; PAM type: YTN; PAM sequence: TTC
ctttaggtgacatttggttg

SEQ ID NO: 31405 - DNA, 20 bp, Artificial Sequence
  Description of Artificial Sequence: Synthetic oligonucleotide
  Target: FXN; (+) strand; PAM type: YTN; PAM sequence: CTT
taggtgacatttggttgatt

SEQ ID NO: 31406 - DNA, 20 bp, Artificial Sequence
  Description of Artificial Sequence: Synthetic oligonucleotide
  Target: FXN; (+) strand; PAM type: YTN; PAM sequence: TTT
aggtgacatttggttgattg

SEQ ID NO: 31407 - DNA, 20 bp, Artificial Sequence
  Description of Artificial Sequence: Synthetic oligonucleotide
  Target: FXN; (+) strand; PAM type: YTN; PAM sequence: TTA
ggtgacatttggttgattgc

SEQ ID NO: 31408 - DNA, 20 bp, Artificial Sequence
  Description of Artificial Sequence: Synthetic oligonucleotide
  Target: FXN; (+) strand; PAM type: YTN; PAM sequence: TTT
ggttgattgcagtgttctgt

SEQ ID NO: 31409 - DNA, 20 bp, Artificial Sequence
  Description of Artificial Sequence: Synthetic oligonucleotide
  Target: FXN; (+) strand; PAM type: YTN; PAM sequence: TTG
gttgattgcagtgttctgtt

SEQ ID NO: 31410 - DNA, 20 bp, Artificial Sequence
  Description of Artificial Sequence: Synthetic oligonucleotide
  Target: FXN; (+) strand; PAM type: YTN; PAM sequence: TTG
attgcagtgttctgttgtta

SEQ ID NO: 31411 - DNA, 20 bp, Artificial Sequence
  Description of Artificial Sequence: Synthetic oligonucleotide
  Target: FXN; (+) strand; PAM type: YTN; PAM sequence: TTG
cagtgttctgttgttacgat

SEQ ID NO: 31412 - DNA, 20 bp, Artificial Sequence
  Description of Artificial Sequence: Synthetic oligonucleotide
  Target: FXN; (+) strand; PAM type: YTN; PAM sequence: TTC
tgttgttacgatggtgctgc

SEQ ID NO: 31413 - DNA, 20 bp, Artificial Sequence
  Description of Artificial Sequence: Synthetic oligonucleotide
  Target: FXN; (+) strand; PAM type: YTN; PAM sequence: CTG
ttgttacgatggtgctgctg

SEQ ID NO: 31414 - DNA, 20 bp, Artificial Sequence
  Description of Artificial Sequence: Synthetic oligonucleotide
  Target: FXN; (+) strand; PAM type: YTN; PAM sequence: TTG
ttacgatggtgctgctgtga

SEQ ID NO: 31415 - DNA, 20 bp, Artificial Sequence
  Description of Artificial Sequence: Synthetic oligonucleotide
  Target: FXN; (+) strand; PAM type: YTN; PAM sequence: TTA
cgatggtgctgctgtgactg

SEQ ID NO: 31416 - DNA, 20 bp, Artificial Sequence
  Description of Artificial Sequence: Synthetic oligonucleotide
  Target: FXN; (+) strand; PAM type: YTN; PAM sequence: CTG
ctgtgactgttcttgtgcat

SEQ ID NO: 31417 - DNA, 20 bp, Artificial Sequence
  Description of Artificial Sequence: Synthetic oligonucleotide
  Target: FXN; (+) strand; PAM type: YTN; PAM sequence: CTG
tgactgttcttgtgcatgga

SEQ ID NO: 31418 - DNA, 20 bp, Artificial Sequence
  Description of Artificial Sequence: Synthetic oligonucleotide
  Target: FXN; (+) strand; PAM type: YTN; PAM sequence: CTG
ttcttgtgcatggacagaag

SEQ ID NO: 31419 - DNA, 20 bp, Artificial Sequence
  Description of Artificial Sequence: Synthetic oligonucleotide
  Target: FXN; (+) strand; PAM type: YTN; PAM sequence: TTC
ttgtgcatggacagaagttc

SEQ ID NO: 31420 - DNA, 20 bp, Artificial Sequence
  Description of Artificial Sequence: Synthetic oligonucleotide
  Target: FXN; (+) strand; PAM type: YTN; PAM sequence: CTT
gtgcatggacagaagttcct

SEQ ID NO: 31421 - DNA, 20 bp, Artificial Sequence
  Description of Artificial Sequence: Synthetic oligonucleotide
  Target: FXN; (+) strand; PAM type: YTN; PAM sequence: TTG
tgcatggacagaagttcctt

SEQ ID NO: 31422 - DNA, 20 bp, Artificial Sequence
  Description of Artificial Sequence: Synthetic oligonucleotide
  Target: FXN; (+) strand; PAM type: YTN; PAM sequence: TTC
ctttcaggtgaatttctcag

SEQ ID NO: 31423 - DNA, 20 bp, Artificial Sequence
  Description of Artificial Sequence: Synthetic oligonucleotide
  Target: FXN; (+) strand; PAM type: YTN; PAM sequence: CTT
tcaggtgaatttctcagaat

SEQ ID NO: 31424 - DNA, 20 bp, Artificial Sequence
  Description of Artificial Sequence: Synthetic oligonucleotide
  Target: FXN; (+) strand; PAM type: YTN; PAM sequence: TTT
caggtgaatttctcagaatg

SEQ ID NO: 31425 - DNA, 20 bp, Artificial Sequence
  Description of Artificial Sequence: Synthetic oligonucleotide
  Target: FXN; (+) strand; PAM type: YTN; PAM sequence: TTC
aggtgaatttctcagaatgg

SEQ ID NO: 31426 - DNA, 20 bp, Artificial Sequence
  Description of Artificial Sequence: Synthetic oligonucleotide
  Target: FXN; (+) strand; PAM type: YTN; PAM sequence: TTT
ctcagaatggaattgctggg

SEQ ID NO: 31427 - DNA, 20 bp, Artificial Sequence
  Description of Artificial Sequence: Synthetic oligonucleotide
  Target: FXN; (+) strand; PAM type: YTN; PAM sequence: TTC
tcagaatggaattgctgggc

SEQ ID NO: 31428 - DNA, 20 bp, Artificial Sequence
  Description of Artificial Sequence: Synthetic oligonucleotide
  Target: FXN; (+) strand; PAM type: YTN; PAM sequence: CTC
agaatggaattgctgggcaa

SEQ ID NO: 31429 - DNA, 20 bp, Artificial Sequence
  Description of Artificial Sequence: Synthetic oligonucleotide
  Target: FXN; (+) strand; PAM type: YTN; PAM sequence: TTG
ctgggcaaaggggcagccaa

SEQ ID NO: 31430 - DNA, 20 bp, Artificial Sequence
  Description of Artificial Sequence: Synthetic oligonucleotide
  Target: FXN; (+) strand; PAM type: YTN; PAM sequence: CTG
ggcaaaggggcagccaataa

SEQ ID NO: 31431 - DNA, 20 bp, Artificial Sequence
  Description of Artificial Sequence: Synthetic oligonucleotide
  Target: FXN; (+) strand; PAM type: YTN; PAM sequence: CTC
atttgatgccaaaagtggtg

SEQ ID NO: 31432 - DNA, 20 bp, Artificial Sequence
  Description of Artificial Sequence: Synthetic oligonucleotide
  Target: FXN; (+) strand; PAM type: YTN; PAM sequence: TTT
gatgccaaaagtggtggtgc

SEQ ID NO: 31433 - DNA, 20 bp, Artificial Sequence
  Description of Artificial Sequence: Synthetic oligonucleotide
  Target: FXN; (+) strand; PAM type: YTN; PAM sequence: TTG
atgccaaaagtggtggtgcc

SEQ ID NO: 31434 - DNA, 20 bp, Artificial Sequence
  Description of Artificial Sequence: Synthetic oligonucleotide
  Target: FXN; (+) strand; PAM type: YTN; PAM sequence: TTC
atcctcccctgcgaggtatg

SEQ ID NO: 31435 - DNA, 20 bp, Artificial Sequence
  Description of Artificial Sequence: Synthetic oligonucleotide
  Target: FXN; (+) strand; PAM type: YTN; PAM sequence: CTC
ccctgcgaggtatgggtcct

SEQ ID NO: 31436 - DNA, 20 bp, Artificial Sequence
  Description of Artificial Sequence: Synthetic oligonucleotide
  Target: FXN; (+) strand; PAM type: YTN; PAM sequence: CTG
cgaggtatgggtcctgattc

SEQ ID NO: 31437 - DNA, 20 bp, Artificial Sequence
  Description of Artificial Sequence: Synthetic oligonucleotide
  Target: FXN; (+) strand; PAM type: YTN; PAM sequence: CTG
attcactcttcaagtgctgt

SEQ ID NO: 31438 - DNA, 20 bp, Artificial Sequence
  Description of Artificial Sequence: Synthetic oligonucleotide
  Target: FXN; (+) strand; PAM type: YTN; PAM sequence: TTC
actcttcaagtgctgtggtt

SEQ ID NO: 31439 - DNA, 20 bp, Artificial Sequence
  Description of Artificial Sequence: Synthetic oligonucleotide
  Target: FXN; (+) strand; PAM type: YTN; PAM sequence: CTC
ttcaagtgctgtggtttgac

SEQ ID NO: 31440 - DNA, 20 bp, Artificial Sequence
  Description of Artificial Sequence: Synthetic oligonucleotide
  Target: FXN; (+) strand; PAM type: YTN; PAM sequence: CTT
caagtgctgtggtttgacag

SEQ ID NO: 31441 - DNA, 20 bp, Artificial Sequence
  Description of Artificial Sequence: Synthetic oligonucleotide
  Target: FXN; (+) strand; PAM type: YTN; PAM sequence: TTC
aagtgctgtggtttgacagg

SEQ ID NO: 31442 - DNA, 20 bp, Artificial Sequence
  Description of Artificial Sequence: Synthetic oligonucleotide
  Target: FXN; (+) strand; PAM type: YTN; PAM sequence: CTG
tggtttgacagggccggggg

SEQ ID NO: 31443 - DNA, 20 bp, Artificial Sequence
  Description of Artificial Sequence: Synthetic oligonucleotide
  Target: FXN; (+) strand; PAM type: YTN; PAM sequence: TTT
gacagggccgggggtgacaa

SEQ ID NO: 31444 - DNA, 20 bp, Artificial Sequence
  Description of Artificial Sequence: Synthetic oligonucleotide
  Target: FXN; (+) strand; PAM type: YTN; PAM sequence: TTG
acagggccgggggtgacaag

SEQ ID NO: 31445 - DNA, 20 bp, Artificial Sequence
  Description of Artificial Sequence: Synthetic oligonucleotide
  Target: FXN; (+) strand; PAM type: YTN; PAM sequence: CTG
ggaaggaaagctgggctccc

SEQ ID NO: 31446 - DNA, 20 bp, Artificial Sequence
  Description of Artificial Sequence: Synthetic oligonucleotide
  Target: FXN; (+) strand; PAM type: YTN; PAM sequence: CTG
ggctccctgctggccatcca

SEQ ID NO: 31447 - DNA, 20 bp, Artificial Sequence
  Description of Artificial Sequence: Synthetic oligonucleotide
  Target: FXN; (+) strand; PAM type: YTN; PAM sequence: CTC
cctgctggccatccaggcca

SEQ ID NO: 31448 - DNA, 20 bp, Artificial Sequence
  Description of Artificial Sequence: Synthetic oligonucleotide
  Target: FXN; (+) strand; PAM type: YTN; PAM sequence: CTG
ctggccatccaggccagtcc

SEQ ID NO: 31449 - DNA, 20 bp, Artificial Sequence
  Description of Artificial Sequence: Synthetic oligonucleotide
  Target: FXN; (+) strand; PAM type: YTN; PAM sequence: CTG
gccatccaggccagtcctta

SEQ ID NO: 31450 - DNA, 20 bp, Artificial Sequence
  Description of Artificial Sequence: Synthetic oligonucleotide
  Target: FXN; (+) strand; PAM type: YTN; PAM sequence: CTT
accagggggtaggcaatgat

SEQ ID NO: 31451 - DNA, 20 bp, Artificial Sequence
  Description of Artificial Sequence: Synthetic oligonucleotide
  Target: FXN; (+) strand; PAM type: YTN; PAM sequence: TTA
ccagggggtaggcaatgatt

SEQ ID NO: 31452 - DNA, 20 bp, Artificial Sequence
  Description of Artificial Sequence: Synthetic oligonucleotide
  Target: FXN; (+) strand; PAM type: YTN; PAM sequence: TTG
ggtcaagtggttcctgacca

SEQ ID NO: 31453 - DNA, 20 bp, Artificial Sequence
  Description of Artificial Sequence: Synthetic oligonucleotide
  Target: FXN; (+) strand; PAM type: YTN; PAM sequence: TTC
ctgaccactgggcctgagac

SEQ ID NO: 31454 - DNA, 20 bp, Artificial Sequence
  Description of Artificial Sequence: Synthetic oligonucleotide
  Target: FXN; (+) strand; PAM type: YTN; PAM sequence: CTG
accactgggcctgagacttc

SEQ ID NO: 31455 - DNA, 20 bp, Artificial Sequence
  Description of Artificial Sequence: Synthetic oligonucleotide
  Target: FXN; (+) strand; PAM type: YTN; PAM sequence: CTG
ggcctgagacttcaggccca

SEQ ID NO: 31456 - DNA, 20 bp, Artificial Sequence
  Description of Artificial Sequence: Synthetic oligonucleotide
  Target: FXN; (+) strand; PAM type: YTN; PAM sequence: CTG
agacttcaggcccagaaact

SEQ ID NO: 31457 - DNA, 20 bp, Artificial Sequence
  Description of Artificial Sequence: Synthetic oligonucleotide
  Target: FXN; (+) strand; PAM type: YTN; PAM sequence: CTT
caggcccagaaactatctaa

SEQ ID NO: 31458 - DNA, 20 bp, Artificial Sequence
  Description of Artificial Sequence: Synthetic oligonucleotide
  Target: FXN; (+) strand; PAM type: YTN; PAM sequence: TTC
aggcccagaaactatctaat

SEQ ID NO: 31459 - DNA, 20 bp, Artificial Sequence
  Description of Artificial Sequence: Synthetic oligonucleotide
  Target: FXN; (+) strand; PAM type: YTN; PAM sequence: CTA
tctaatatttcctcaaatgc

SEQ ID NO: 31460 - DNA, 20 bp, Artificial Sequence
  Description of Artificial Sequence: Synthetic oligonucleotide
  Target: FXN; (+) strand; PAM type: YTN; PAM sequence: CTA
atatttcctcaaatgcatcc

SEQ ID NO: 31461 - DNA, 20 bp, Artificial Sequence
  Description of Artificial Sequence: Synthetic oligonucleotide
  Target: FXN; (+) strand; PAM type: YTN; PAM sequence: TTT
cctcaaatgcatcccatgag

SEQ ID NO: 31462 - DNA, 20 bp, Artificial Sequence
  Description of Artificial Sequence: Synthetic oligonucleotide
  Target: FXN; (+) strand; PAM type: YTN; PAM sequence: TTC
ctcaaatgcatcccatgagc

SEQ ID NO: 31463 - DNA, 20 bp, Artificial Sequence
  Description of Artificial Sequence: Synthetic oligonucleotide
  Target: FXN; (+) strand; PAM type: YTN; PAM sequence: CTC
aaatgcatcccatgagcagg

SEQ ID NO: 31464 - DNA, 20 bp, Artificial Sequence
  Description of Artificial Sequence: Synthetic oligonucleotide
  Target: FXN; (+) strand; PAM type: YTN; PAM sequence: CTG
tgtgagtgagcacacacatc

SEQ ID NO: 31465 - DNA, 20 bp, Artificial Sequence
  Description of Artificial Sequence: Synthetic oligonucleotide
  Target: FXN; (+) strand; PAM type: YTN; PAM sequence: CTG
aagcctcaagctaggcaagc

SEQ ID NO: 31466 - DNA, 20 bp, Artificial Sequence
  Description of Artificial Sequence: Synthetic oligonucleotide
  Target: FXN; (+) strand; PAM type: YTN; PAM sequence: CTC
aagctaggcaagcctaccat

SEQ ID NO: 31467 - DNA, 20 bp, Artificial Sequence
  Description of Artificial Sequence: Synthetic oligonucleotide
  Target: FXN; (+) strand; PAM type: YTN; PAM sequence: CTA
ggcaagcctaccatgacttg

SEQ ID NO: 31468 - DNA, 20 bp, Artificial Sequence
  Description of Artificial Sequence: Synthetic oligonucleotide
  Target: FXN; (+) strand; PAM type: YTN; PAM sequence: CTA
ccatgacttgtggtccaagg

SEQ ID NO: 31469 - DNA, 20 bp, Artificial Sequence
  Description of Artificial Sequence: Synthetic oligonucleotide
  Target: FXN; (+) strand; PAM type: YTN; PAM sequence: CTT
gtggtccaagggctcacggg

SEQ ID NO: 31470 - DNA, 20 bp, Artificial Sequence
  Description of Artificial Sequence: Synthetic oligonucleotide
  Target: FXN; (+) strand; PAM type: YTN; PAM sequence: TTG
tggtccaagggctcacgggt

SEQ ID NO: 31471 - DNA, 20 bp, Artificial Sequence
  Description of Artificial Sequence: Synthetic oligonucleotide
  Target: FXN; (+) strand; PAM type: YTN; PAM sequence: CTC
acgggtgacctggagttaga

SEQ ID NO: 31472 - DNA, 20 bp, Artificial Sequence
  Description of Artificial Sequence: Synthetic oligonucleotide
  Target: FXN; (+) strand; PAM type: YTN; PAM sequence: CTG
gagttagagggagacatggc

SEQ ID NO: 31473 - DNA, 20 bp, Artificial Sequence
  Description of Artificial Sequence: Synthetic oligonucleotide
  Target: FXN; (+) strand; PAM type: YTN; PAM sequence: TTA
gagggagacatggctgccag

SEQ ID NO: 31474 - DNA, 20 bp, Artificial Sequence
  Description of Artificial Sequence: Synthetic oligonucleotide
  Target: FXN; (+) strand; PAM type: YTN; PAM sequence: CTG
ccaggtggctttagaaagaa

SEQ ID NO: 31475 - DNA, 20 bp, Artificial Sequence
  Description of Artificial Sequence: Synthetic oligonucleotide
  Target: FXN; (+) strand; PAM type: YTN; PAM sequence: CTT
tagaaagaacactcatcatg

SEQ ID NO: 31476 - DNA, 20 bp, Artificial Sequence
  Description of Artificial Sequence: Synthetic oligonucleotide
  Target: FXN; (+) strand; PAM type: YTN; PAM sequence: TTT
agaaagaacactcatcatgg

SEQ ID NO: 31477 - DNA, 20 bp, Artificial Sequence
  Description of Artificial Sequence: Synthetic oligonucleotide
  Target: FXN; (+) strand; PAM type: YTN; PAM sequence: TTA
gaaagaacactcatcatggc

SEQ ID NO: 31478 - DNA, 20 bp, Artificial Sequence
  Description of Artificial Sequence: Synthetic oligonucleotide
  Target: FXN; (+) strand; PAM type: YTN; PAM sequence: CTC
atcatggccaggtgcggtgg

SEQ ID NO: 31479 - DNA, 20 bp, Artificial Sequence
  Description of Artificial Sequence: Synthetic oligonucleotide
  Target: FXN; (+) strand; PAM type: YTN; PAM sequence: CTT
acgcctgtaatcccagcact

SEQ ID NO: 31480 - DNA, 20 bp, Artificial Sequence
  Description of Artificial Sequence: Synthetic oligonucleotide
  Target: FXN; (+) strand; PAM type: YTN; PAM sequence: TTA
cgcctgtaatcccagcactt

SEQ ID NO: 31481 - DNA, 20 bp, Artificial Sequence
  Description of Artificial Sequence: Synthetic oligonucleotide
  Target: FXN; (+) strand; PAM type: YTN; PAM sequence: CTG
taatcccagcactttgggag

SEQ ID NO: 31482 - DNA, 20 bp, Artificial Sequence
  Description of Artificial Sequence: Synthetic oligonucleotide
  Target: FXN; (+) strand; PAM type: YTN; PAM sequence: CTT
tgggaggccaaggtgggtgg

SEQ ID NO: 31483 - DNA, 20 bp, Artificial Sequence
  Description of Artificial Sequence: Synthetic oligonucleotide
  Target: FXN; (+) strand; PAM type: YTN; PAM sequence: TTT
gggaggccaaggtgggtgga

SEQ ID NO: 31484 - DNA, 20 bp, Artificial Sequence
  Description of Artificial Sequence: Synthetic oligonucleotide
  Target: FXN; (+) strand; PAM type: YTN; PAM sequence: TTG
ggaggccaaggtgggtggat

SEQ ID NO: 31485 - DNA, 20 bp, Artificial Sequence
  Description of Artificial Sequence: Synthetic oligonucleotide
  Target: FXN; (+) strand; PAM type: YTN; PAM sequence: CTG
accaacatgctgaaacctgt

SEQ ID NO: 31486 - DNA, 20 bp, Artificial Sequence
  Description of Artificial Sequence: Synthetic oligonucleotide
  Target: FXN; (+) strand; PAM type: YTN; PAM sequence: CTG
aaacctgtctctcctaaaaa

SEQ ID NO: 31487 - DNA, 20 bp, Artificial Sequence
  Description of Artificial Sequence: Synthetic oligonucleotide
  Target: FXN; (+) strand; PAM type: YTN; PAM sequence: CTG
tctctcctaaaaacacaaaa

SEQ ID NO: 31488 - DNA, 20 bp, Artificial Sequence
  Description of Artificial Sequence: Synthetic oligonucleotide
  Target: FXN; (+) strand; PAM type: YTN; PAM sequence: CTC
tcctaaaaacacaaaaatta

SEQ ID NO: 31489 - DNA, 20 bp, Artificial Sequence
  Description of Artificial Sequence: Synthetic oligonucleotide
  Target: FXN; (+) strand; PAM type: YTN; PAM sequence: CTC
ctaaaaacacaaaaattagc

SEQ ID NO: 31490 - DNA, 20 bp, Artificial Sequence
  Description of Artificial Sequence: Synthetic oligonucleotide
  Target: FXN; (+) strand; PAM type: YTN; PAM sequence: CTA
aaaacacaaaaattagctgg

SEQ ID NO: 31491 - DNA, 20 bp, Artificial Sequence
  Description of Artificial Sequence: Synthetic oligonucleotide
  Target: FXN; (+) strand; PAM type: YTN; PAM sequence: TTA
gctgggcatggaggtgcacg

SEQ ID NO: 31492 - DNA, 20 bp, Artificial Sequence
  Description of Artificial Sequence: Synthetic oligonucleotide
  Target: FXN; (+) strand; PAM type: YTN; PAM sequence: CTG
ggcatggaggtgcacgcctg

SEQ ID NO: 31493 - DNA, 20 bp, Artificial Sequence
  Description of Artificial Sequence: Synthetic oligonucleotide
  Target: FXN; (+) strand; PAM type: YTN; PAM sequence: CTG
taatcccagctactcaggag

SEQ ID NO: 31494 - DNA, 20 bp, Artificial Sequence
  Description of Artificial Sequence: Synthetic oligonucleotide
  Target: FXN; (+) strand; PAM type: YTN; PAM sequence: CTA
ctcaggaggctgaggcagga

SEQ ID NO: 31495 - DNA, 20 bp, Artificial Sequence
  Description of Artificial Sequence: Synthetic oligonucleotide
  Target: FXN; (+) strand; PAM type: YTN; PAM sequence: CTC
aggaggctgaggcaggagaa

SEQ ID NO: 31496 - DNA, 20 bp, Artificial Sequence
  Description of Artificial Sequence: Synthetic oligonucleotide
  Target: FXN; (+) strand; PAM type: YTN; PAM sequence: CTG
aggcaggagaatcacttgaa

SEQ ID NO: 31497 - DNA, 20 bp, Artificial Sequence
  Description of Artificial Sequence: Synthetic oligonucleotide
  Target: FXN; (+) strand; PAM type: YTN; PAM sequence: CTT
gaacccgggaggcggaggtt

SEQ ID NO: 31498 - DNA, 20 bp, Artificial Sequence
  Description of Artificial Sequence: Synthetic oligonucleotide
  Target: FXN; (+) strand; PAM type: YTN; PAM sequence: TTG
aacccgggaggcggaggttg

SEQ ID NO: 31499 - DNA, 20 bp, Artificial Sequence
  Description of Artificial Sequence: Synthetic oligonucleotide
  Target: FXN; (+) strand; PAM type: YTN; PAM sequence: TTG
caataagcctagattgtgcc

SEQ ID NO: 31500 - DNA, 20 bp, Artificial Sequence
  Description of Artificial Sequence: Synthetic oligonucleotide
  Target: FXN; (+) strand; PAM type: YTN; PAM sequence: CTA
gattgtgccactgcattcca

SEQ ID NO: 31501 - DNA, 20 bp, Artificial Sequence
  Description of Artificial Sequence: Synthetic oligonucleotide
  Target: FXN; (+) strand; PAM type: YTN; PAM sequence: TTG
tgccactgcattccagcctg

SEQ ID NO: 31502 - DNA, 20 bp, Artificial Sequence
  Description of Artificial Sequence: Synthetic oligonucleotide
  Target: FXN; (+) strand; PAM type: YTN; PAM sequence: CTG
cattccagcctgggcaacag

SEQ ID NO: 31503 - DNA, 20 bp, Artificial Sequence
  Description of Artificial Sequence: Synthetic oligonucleotide
  Target: FXN; (+) strand; PAM type: YTN; PAM sequence: TTC
cagcctgggcaacagagcaa

SEQ ID NO: 31504 - DNA, 20 bp, Artificial Sequence
  Description of Artificial Sequence: Synthetic oligonucleotide
  Target: FXN; (+) strand; PAM type: YTN; PAM sequence: CTG
ggcaacagagcaagactccg

SEQ ID NO: 31505 - DNA, 20 bp, Artificial Sequence
  Description of Artificial Sequence: Synthetic oligonucleotide
  Target: FXN; (+) strand; PAM type: YTN; PAM sequence: CTC
cgtctcagaaaaaaaaaaaa

SEQ ID NO: 31506 - DNA, 20 bp, Artificial Sequence
  Description of Artificial Sequence: Synthetic oligonucleotide
  Target: FXN; (+) strand; PAM type: YTN; PAM sequence: CTC
agaaaaaaaaaaaaaaagga

SEQ ID NO: 31507 - DNA, 20 bp, Artificial Sequence
  Description of Artificial Sequence: Synthetic oligonucleotide
  Target: FXN; (+) strand; PAM type: YTN; PAM sequence: CTC
atcctatgaccttgacctcc

SEQ ID NO: 31508 - DNA, 20 bp, Artificial Sequence
  Description of Artificial Sequence: Synthetic oligonucleotide
  Target: FXN; (+) strand; PAM type: YTN; PAM sequence: CTA
tgaccttgacctccaagctt

SEQ ID NO: 31509 - DNA, 20 bp, Artificial Sequence
  Description of Artificial Sequence: Synthetic oligonucleotide
  Target: FXN; (+) strand; PAM type: YTN; PAM sequence: CTT
gacctccaagctttgcctcc

SEQ ID NO: 31510 - DNA, 20 bp, Artificial Sequence
  Description of Artificial Sequence: Synthetic oligonucleotide
  Target: FXN; (+) strand; PAM type: YTN; PAM sequence: TTG
acctccaagctttgcctccc

SEQ ID NO: 31511 - DNA, 20 bp, Artificial Sequence
  Description of Artificial Sequence: Synthetic oligonucleotide
  Target: FXN; (+) strand; PAM type: YTN; PAM sequence: CTC
caagctttgcctccctcaag

SEQ ID NO: 31512 - DNA, 20 bp, Artificial Sequence
  Description of Artificial Sequence: Synthetic oligonucleotide
  Target: FXN; (+) strand; PAM type: YTN; PAM sequence: CTT
tgcctccctcaagcagaaca

SEQ ID NO: 31513 - DNA, 20 bp, Artificial Sequence
  Description of Artificial Sequence: Synthetic oligonucleotide
  Target: FXN; (+) strand; PAM type: YTN; PAM sequence: TTT
gcctccctcaagcagaacag

SEQ ID NO: 31514 - DNA, 20 bp, Artificial Sequence
  Description of Artificial Sequence: Synthetic oligonucleotide
  Target: FXN; (+) strand; PAM type: YTN; PAM sequence: TTG
cctccctcaagcagaacaga

SEQ ID NO: 31515 - DNA, 20 bp, Artificial Sequence
  Description of Artificial Sequence: Synthetic oligonucleotide
  Target: FXN; (+) strand; PAM type: YTN; PAM sequence: CTC
cctcaagcagaacagaatgg

SEQ ID NO: 31516 - DNA, 20 bp, Artificial Sequence
  Description of Artificial Sequence: Synthetic oligonucleotide
  Target: FXN; (+) strand; PAM type: YTN; PAM sequence: CTC
aagcagaacagaatggagcc

SEQ ID NO: 31517 - DNA, 20 bp, Artificial Sequence
  Description of Artificial Sequence: Synthetic oligonucleotide
  Target: FXN; (+) strand; PAM type: YTN; PAM sequence: CTC
ccttaggcagaggcggaagt

SEQ ID NO: 31518 - DNA, 20 bp, Artificial Sequence
  Description of Artificial Sequence: Synthetic oligonucleotide
  Target: FXN; (+) strand; PAM type: YTN; PAM sequence: CTT
aggcagaggcggaagtttgc

SEQ ID NO: 31519 - DNA, 20 bp, Artificial Sequence
  Description of Artificial Sequence: Synthetic oligonucleotide
  Target: FXN; (+) strand; PAM type: YTN; PAM sequence: TTA
ggcagaggcggaagtttgcc

SEQ ID NO: 31520 - DNA, 20 bp, Artificial Sequence
  Description of Artificial Sequence: Synthetic oligonucleotide
  Target: FXN; (+) strand; PAM type: YTN; PAM sequence: TTT
gcctctcacctagttctcca

SEQ ID NO: 31521 - DNA, 20 bp, Artificial Sequence
  Description of Artificial Sequence: Synthetic oligonucleotide
  Target: FXN; (+) strand; PAM type: YTN; PAM sequence: TTG
cctctcacctagttctccat

SEQ ID NO: 31522 - DNA, 20 bp, Artificial Sequence
  Description of Artificial Sequence: Synthetic oligonucleotide
  Target: FXN; (+) strand; PAM type: YTN; PAM sequence: CTC
tcacctagttctccattctt

SEQ ID NO: 31523 - DNA, 20 bp, Artificial Sequence
  Description of Artificial Sequence: Synthetic oligonucleotide
  Target: FXN; (+) strand; PAM type: YTN; PAM sequence: CTC
acctagttctccattctttt

SEQ ID NO: 31524 - DNA, 20 bp, Artificial Sequence
  Description of Artificial Sequence: Synthetic oligonucleotide
  Target: FXN; (+) strand; PAM type: YTN; PAM sequence: CTA
gttctccattcttttgttca

SEQ ID NO: 31525 - DNA, 20 bp, Artificial Sequence
  Description of Artificial Sequence: Synthetic oligonucleotide
  Target: FXN; (+) strand; PAM type: YTN; PAM sequence: TTC
tccattcttttgttcagagc

SEQ ID NO: 31526 - DNA, 20 bp, Artificial Sequence
  Description of Artificial Sequence: Synthetic oligonucleotide
  Target: FXN; (+) strand; PAM type: YTN; PAM sequence: CTC
cattcttttgttcagagcct

SEQ ID NO: 31527 - DNA, 20 bp, Artificial Sequence
  Description of Artificial Sequence: Synthetic oligonucleotide
  Target: FXN; (+) strand; PAM type: YTN; PAM sequence: TTC
ttttgttcagagcctgaata

SEQ ID NO: 31528 - DNA, 20 bp, Artificial Sequence
  Description of Artificial Sequence: Synthetic oligonucleotide
  Target: FXN; (+) strand; PAM type: YTN; PAM sequence: CTT
ttgttcagagcctgaatacc

SEQ ID NO: 31529 - DNA, 20 bp, Artificial Sequence
  Description of Artificial Sequence: Synthetic oligonucleotide
  Target: FXN; (+) strand; PAM type: YTN; PAM sequence: TTT
tgttcagagcctgaataccc

SEQ ID NO: 31530 - DNA, 20 bp, Artificial Sequence
  Description of Artificial Sequence: Synthetic oligonucleotide
  Target: FXN; (+) strand; PAM type: YTN; PAM sequence: TTT
gttcagagcctgaataccct

SEQ ID NO: 31531 - DNA, 20 bp, Artificial Sequence
  Description of Artificial Sequence: Synthetic oligonucleotide
  Target: FXN; (+) strand; PAM type: YTN; PAM sequence: TTG
ttcagagcctgaataccctc

SEQ ID NO: 31532 - DNA, 20 bp, Artificial Sequence
  Description of Artificial Sequence: Synthetic oligonucleotide
  Target: FXN; (+) strand; PAM type: YTN; PAM sequence: TTC
agagcctgaataccctcagg

SEQ ID NO: 31533 - DNA, 20 bp, Artificial Sequence
  Description of Artificial Sequence: Synthetic oligonucleotide
  Target: FXN; (+) strand; PAM type: YTN; PAM sequence: CTG
aataccctcaggctctgtac

SEQ ID NO: 31534 - DNA, 20 bp, Artificial Sequence
  Description of Artificial Sequence: Synthetic oligonucleotide
  Target: FXN; (+) strand; PAM type: YTN; PAM sequence: CTC
aggctctgtacttggggtat

SEQ ID NO: 31535 - DNA, 20 bp, Artificial Sequence
  Description of Artificial Sequence: Synthetic oligonucleotide
  Target: FXN; (+) strand; PAM type: YTN; PAM sequence: CTC
tgtacttggggtatttctgt

SEQ ID NO: 31536 - DNA, 20 bp, Artificial Sequence
  Description of Artificial Sequence: Synthetic oligonucleotide
  Target: FXN; (+) strand; PAM type: YTN; PAM sequence: CTG
tacttggggtatttctgttc

SEQ ID NO: 31537 - DNA, 20 bp, Artificial Sequence
  Description of Artificial Sequence: Synthetic oligonucleotide
  Target: FXN; (+) strand; PAM type: YTN; PAM sequence: CTT
ggggtatttctgttctcttg

SEQ ID NO: 31538 - DNA, 20 bp, Artificial Sequence
  Description of Artificial Sequence: Synthetic oligonucleotide
  Target: FXN; (+) strand; PAM type: YTN; PAM sequence: TTG
gggtatttctgttctcttgt

SEQ ID NO: 31539 - DNA, 20 bp, Artificial Sequence
  Description of Artificial Sequence: Synthetic oligonucleotide
  Target: FXN; (+) strand; PAM type: YTN; PAM sequence: TTT
ctgttctcttgttttatgct

SEQ ID NO: 31540 - DNA, 20 bp, Artificial Sequence
  Description of Artificial Sequence: Synthetic oligonucleotide
  Target: FXN; (+) strand; PAM type: YTN; PAM sequence: TTC
tgttctcttgttttatgctc

SEQ ID NO: 31541 - DNA, 20 bp, Artificial Sequence
  Description of Artificial Sequence: Synthetic oligonucleotide
  Target: FXN; (+) strand; PAM type: YTN; PAM sequence: CTG
ttctcttgttttatgctcac

SEQ ID NO: 31542 - DNA, 20 bp, Artificial Sequence
  Description of Artificial Sequence: Synthetic oligonucleotide
  Target: FXN; (+) strand; PAM type: YTN; PAM sequence: TTC
tcttgttttatgctcacggt

SEQ ID NO: 31543 - DNA, 20 bp, Artificial Sequence
  Description of Artificial Sequence: Synthetic oligonucleotide
  Target: FXN; (+) strand; PAM type: YTN; PAM sequence: CTC
ttgttttatgctcacggttg

SEQ ID NO: 31544 - DNA, 20 bp, Artificial Sequence
  Description of Artificial Sequence: Synthetic oligonucleotide
  Target: FXN; (+) strand; PAM type: YTN; PAM sequence: CTT
gttttatgctcacggttgtg

SEQ ID NO: 31545 - DNA, 20 bp, Artificial Sequence
  Description of Artificial Sequence: Synthetic oligonucleotide
  Target: FXN; (+) strand; PAM type: YTN; PAM sequence: TTG
ttttatgctcacggttgtga

SEQ ID NO: 31546 - DNA, 20 bp, Artificial Sequence
  Description of Artificial Sequence: Synthetic oligonucleotide
  Target: FXN; (+) strand; PAM type: YTN; PAM sequence: TTT
tatgctcacggttgtgaggt

SEQ ID NO: 31547 - DNA, 20 bp, Artificial Sequence
  Description of Artificial Sequence: Synthetic oligonucleotide
  Target: FXN; (+) strand; PAM type: YTN; PAM sequence: TTT
atgctcacggttgtgaggtt

SEQ ID NO: 31548 - DNA, 20 bp, Artificial Sequence
  Description of Artificial Sequence: Synthetic oligonucleotide
  Target: FXN; (+) strand; PAM type: YTN; PAM sequence: TTA
tgctcacggttgtgaggttt

SEQ ID NO: 31549 - DNA, 20 bp, Artificial Sequence
  Description of Artificial Sequence: Synthetic oligonucleotide
  Target: FXN; (+) strand; PAM type: YTN; PAM sequence: CTC
acggttgtgaggtttgttgt

SEQ ID NO: 31550 - DNA, 20 bp, Artificial Sequence
  Description of Artificial Sequence: Synthetic oligonucleotide
  Target: FXN; (+) strand; PAM type: YTN; PAM sequence: TTG
tgaggtttgttgtgagtacc

SEQ ID NO: 31551 - DNA, 20 bp, Artificial Sequence
  Description of Artificial Sequence: Synthetic oligonucleotide
  Target: FXN; (+) strand; PAM type: YTN; PAM sequence: TTT
gttgtgagtaccacgatccc

SEQ ID NO: 31552 - DNA, 20 bp, Artificial Sequence
  Description of Artificial Sequence: Synthetic oligonucleotide
  Target: FXN; (+) strand; PAM type: YTN; PAM sequence: TTG
ttgtgagtaccacgatccct

SEQ ID NO: 31553 - DNA, 20 bp, Artificial Sequence
  Description of Artificial Sequence: Synthetic oligonucleotide
  Target: FXN; (+) strand; PAM type: YTN; PAM sequence: TTG
tgagtaccacgatcccttcc

SEQ ID NO: 31554 - DNA, 20 bp, Artificial Sequence
  Description of Artificial Sequence: Synthetic oligonucleotide
  Target: FXN; (+) strand; PAM type: YTN; PAM sequence: CTT
ccttcagaggagtaaactga

SEQ ID NO: 31555 - DNA, 20 bp, Artificial Sequence
  Description of Artificial Sequence: Synthetic oligonucleotide
  Target: FXN; (+) strand; PAM type: YTN; PAM sequence: TTC
cttcagaggagtaaactgag

SEQ ID NO: 31556 - DNA, 20 bp, Artificial Sequence
  Description of Artificial Sequence: Synthetic oligonucleotide
  Target: FXN; (+) strand; PAM type: YTN; PAM sequence: CTT
cagaggagtaaactgaggtt

SEQ ID NO: 31557 - DNA, 20 bp, Artificial Sequence
  Description of Artificial Sequence: Synthetic oligonucleotide
  Target: FXN; (+) strand; PAM type: YTN; PAM sequence: TTC
agaggagtaaactgaggttc

SEQ ID NO: 31558 - DNA, 20 bp, Artificial Sequence
  Description of Artificial Sequence: Synthetic oligonucleotide
  Target: FXN; (+) strand; PAM type: YTN; PAM sequence: CTG
aggttccaaaaggtttagca

SEQ ID NO: 31559 - DNA, 20 bp, Artificial Sequence
  Description of Artificial Sequence: Synthetic oligonucleotide
  Target: FXN; (+) strand; PAM type: YTN; PAM sequence: TTC
caaaaggtttagcagttgcc

SEQ ID NO: 31560 - DNA, 20 bp, Artificial Sequence
  Description of Artificial Sequence: Synthetic oligonucleotide
  Target: FXN; (+) strand; PAM type: YTN; PAM sequence: TTT
agcagttgcccgaggaatat

SEQ ID NO: 31561 - DNA, 20 bp, Artificial Sequence
  Description of Artificial Sequence: Synthetic oligonucleotide
  Target: FXN; (+) strand; PAM type: YTN; PAM sequence: TTA
gcagttgcccgaggaatatt

SEQ ID NO: 31562 - DNA, 20 bp, Artificial Sequence
  Description of Artificial Sequence: Synthetic oligonucleotide
  Target: FXN; (+) strand; PAM type: YTN; PAM sequence: TTG
cccgaggaatattaaattgg

SEQ ID NO: 31563 - DNA, 20 bp, Artificial Sequence
  Description of Artificial Sequence: Synthetic oligonucleotide
  Target: FXN; (+) strand; PAM type: YTN; PAM sequence: TTA
aattggcaaaagcaggtaga

SEQ ID NO: 31564 - DNA, 20 bp, Artificial Sequence
  Description of Artificial Sequence: Synthetic oligonucleotide
  Target: FXN; (+) strand; PAM type: YTN; PAM sequence: TTG
gcaaaagcaggtagaatata

SEQ ID NO: 31565 - DNA, 20 bp, Artificial Sequence
  Description of Artificial Sequence: Synthetic oligonucleotide
  Target: FXN; (+) strand; PAM type: YTN; PAM sequence: TTT
ggcaacggttcttttttatg

SEQ ID NO: 31566 - DNA, 20 bp, Artificial Sequence
  Description of Artificial Sequence: Synthetic oligonucleotide
  Target: FXN; (+) strand; PAM type: YTN; PAM sequence: TTG
gcaacggttcttttttatga

SEQ ID NO: 31567 - DNA, 20 bp, Artificial Sequence
  Description of Artificial Sequence: Synthetic oligonucleotide
  Target: FXN; (+) strand; PAM type: YTN; PAM sequence: TTC
ttttttatgattaaaaacag

SEQ ID NO: 31568 - DNA, 20 bp, Artificial Sequence
  Description of Artificial Sequence: Synthetic oligonucleotide
  Target: FXN; (+) strand; PAM type: YTN; PAM sequence: CTT
ttttatgattaaaaacagcc

SEQ ID NO: 31569 - DNA, 20 bp, Artificial Sequence
  Description of Artificial Sequence: Synthetic oligonucleotide
  Target: FXN; (+) strand; PAM type: YTN; PAM sequence: TTT
tttatgattaaaaacagccg

SEQ ID NO: 31570 - DNA, 20 bp, Artificial Sequence
  Description of Artificial Sequence: Synthetic oligonucleotide
  Target: FXN; (+) strand; PAM type: YTN; PAM sequence: TTT
ttatgattaaaaacagccga

SEQ ID NO: 31571 - DNA, 20 bp, Artificial Sequence
  Description of Artificial Sequence: Synthetic oligonucleotide
  Target: FXN; (+) strand; PAM type: YTN; PAM sequence: TTT
tatgattaaaaacagccgaa

SEQ ID NO: 31572 - DNA, 20 bp, Artificial Sequence
  Description of Artificial Sequence: Synthetic oligonucleotide
  Target: FXN; (+) strand; PAM type: YTN; PAM sequence: TTT
atgattaaaaacagccgaag

SEQ ID NO: 31573 - DNA, 20 bp, Artificial Sequence
  Description of Artificial Sequence: Synthetic oligonucleotide
  Target: FXN; (+) strand; PAM type: YTN; PAM sequence: TTA
tgattaaaaacagccgaaga

SEQ ID NO: 31574 - DNA, 20 bp, Artificial Sequence
  Description of Artificial Sequence: Synthetic oligonucleotide
  Target: FXN; (+) strand; PAM type: YTN; PAM sequence: TTA
aaaacagccgaagaaagact

SEQ ID NO: 31575 - DNA, 20 bp, Artificial Sequence
  Description of Artificial Sequence: Synthetic oligonucleotide
  Target: FXN; (+) strand; PAM type: YTN; PAM sequence: CTT
ctacttgtgcctttgaagga

SEQ ID NO: 31576 - DNA, 20 bp, Artificial Sequence
  Description of Artificial Sequence: Synthetic oligonucleotide
  Target: FXN; (+) strand; PAM type: YTN; PAM sequence: TTC
tacttgtgcctttgaaggag

SEQ ID NO: 31577 - DNA, 20 bp, Artificial Sequence
  Description of Artificial Sequence: Synthetic oligonucleotide
  Target: FXN; (+) strand; PAM type: YTN; PAM sequence: CTA
cttgtgcctttgaaggagta

SEQ ID NO: 31578 - DNA, 20 bp, Artificial Sequence
  Description of Artificial Sequence: Synthetic oligonucleotide
  Target: FXN; (+) strand; PAM type: YTN; PAM sequence: CTT
gtgcctttgaaggagtaact

SEQ ID NO: 31579 - DNA, 20 bp, Artificial Sequence
  Description of Artificial Sequence: Synthetic oligonucleotide
  Target: FXN; (+) strand; PAM type: YTN; PAM sequence: TTG
tgcctttgaaggagtaactg

SEQ ID NO: 31580 - DNA, 20 bp, Artificial Sequence
  Description of Artificial Sequence: Synthetic oligonucleotide
  Target: FXN; (+) strand; PAM type: YTN; PAM sequence: CTT
tgaaggagtaactgcatttg

SEQ ID NO: 31581 - DNA, 20 bp, Artificial Sequence
  Description of Artificial Sequence: Synthetic oligonucleotide
  Target: FXN; (+) strand; PAM type: YTN; PAM sequence: TTT
gaaggagtaactgcatttga

SEQ ID NO: 31582 - DNA, 20 bp, Artificial Sequence
  Description of Artificial Sequence: Synthetic oligonucleotide
  Target: FXN; (+) strand; PAM type: YTN; PAM sequence: TTG
aaggagtaactgcatttgac

SEQ ID NO: 31583 - DNA, 20 bp, Artificial Sequence
  Description of Artificial Sequence: Synthetic oligonucleotide
  Target: FXN; (+) strand; PAM type: YTN; PAM sequence: CTG
catttgaccttcccaccagt

SEQ ID NO: 31584 - DNA, 20 bp, Artificial Sequence
  Description of Artificial Sequence: Synthetic oligonucleotide
  Target: FXN; (+) strand; PAM type: YTN; PAM sequence: TTT
gaccttcccaccagtaacaa

SEQ ID NO: 31585 - DNA, 20 bp, Artificial Sequence
  Description of Artificial Sequence: Synthetic oligonucleotide
  Target: FXN; (+) strand; PAM type: YTN; PAM sequence: TTG
accttcccaccagtaacaac

SEQ ID NO: 31586 - DNA, 20 bp, Artificial Sequence
  Description of Artificial Sequence: Synthetic oligonucleotide
  Target: FXN; (+) strand; PAM type: YTN; PAM sequence: CTT
cccaccagtaacaaccatca

SEQ ID NO: 31587 - DNA, 20 bp, Artificial Sequence
  Description of Artificial Sequence: Synthetic oligonucleotide
  Target: FXN; (+) strand; PAM type: YTN; PAM sequence: TTC
ccaccagtaacaaccatcaa

SEQ ID NO: 31588 - DNA, 20 bp, Artificial Sequence
  Description of Artificial Sequence: Synthetic oligonucleotide
  Target: FXN; (+) strand; PAM type: YTN; PAM sequence: CTC
tattaaattaaacacacaca

SEQ ID NO: 31589 - DNA, 20 bp, Artificial Sequence
  Description of Artificial Sequence: Synthetic oligonucleotide
  Target: FXN; (+) strand; PAM type: YTN; PAM sequence: CTA
ttaaattaaacacacacaca

SEQ ID NO: 31590 - DNA, 20 bp, Artificial Sequence
  Description of Artificial Sequence: Synthetic oligonucleotide
  Target: FXN; (+) strand; PAM type: YTN; PAM sequence: TTA
aattaaacacacacacacac

SEQ ID NO: 31591 - DNA, 20 bp, Artificial Sequence
  Description of Artificial Sequence: Synthetic oligonucleotide
  Target: FXN; (+) strand; PAM type: YTN; PAM sequence: TTA
aacacacacacacacaaaca

SEQ ID NO: 31592 - DNA, 20 bp, Artificial Sequence
  Description of Artificial Sequence: Synthetic oligonucleotide
  Target: FXN; (+) strand; PAM type: YTN; PAM sequence: CTA
ttgtgaaggtatcagcgact

SEQ ID NO: 31593 - DNA, 20 bp, Artificial Sequence
  Description of Artificial Sequence: Synthetic oligonucleotide
  Target: FXN; (+) strand; PAM type: YTN; PAM sequence: TTG
tgaaggtatcagcgactaag

SEQ ID NO: 31594 - DNA, 20 bp, Artificial Sequence
  Description of Artificial Sequence: Synthetic oligonucleotide
  Target: FXN; (+) strand; PAM type: YTN; PAM sequence: CTA
agacaactaaggtttgaggg

SEQ ID NO: 31595 - DNA, 20 bp, Artificial Sequence
  Description of Artificial Sequence: Synthetic oligonucleotide
  Target: FXN; (+) strand; PAM type: YTN; PAM sequence: CTA
aggtttgaggggccaggatc

SEQ ID NO: 31596 - DNA, 20 bp, Artificial Sequence
  Description of Artificial Sequence: Synthetic oligonucleotide
  Target: FXN; (+) strand; PAM type: YTN; PAM sequence: TTT
gaggggccaggatcctggag

SEQ ID NO: 31597 - DNA, 20 bp, Artificial Sequence
  Description of Artificial Sequence: Synthetic oligonucleotide
  Target: FXN; (+) strand; PAM type: YTN; PAM sequence: TTG
aggggccaggatcctggaga

SEQ ID NO: 31598 - DNA, 20 bp, Artificial Sequence
  Description of Artificial Sequence: Synthetic oligonucleotide
  Target: FXN; (+) strand; PAM type: YTN; PAM sequence: CTG
gagagatggaaacttccctg

SEQ ID NO: 31599 - DNA, 20 bp, Artificial Sequence
  Description of Artificial Sequence: Synthetic oligonucleotide
  Target: FXN; (+) strand; PAM type: YTN; PAM sequence: CTT
ccctgaggtgagccccacat

SEQ ID NO: 31600 - DNA, 20 bp, Artificial Sequence
  Description of Artificial Sequence: Synthetic oligonucleotide
  Target: FXN; (+) strand; PAM type: YTN; PAM sequence: TTC
cctgaggtgagccccacatt

SEQ ID NO: 31601 - DNA, 20 bp, Artificial Sequence
  Description of Artificial Sequence: Synthetic oligonucleotide
  Target: FXN; (+) strand; PAM type: YTN; PAM sequence: CTG
aggtgagccccacattctca

SEQ ID NO: 31602 - DNA, 20 bp, Artificial Sequence
  Description of Artificial Sequence: Synthetic oligonucleotide
  Target: FXN; (+) strand; PAM type: YTN; PAM sequence: TTC
tcagacacttttccttggat

SEQ ID NO: 31603 - DNA, 20 bp, Artificial Sequence
  Description of Artificial Sequence: Synthetic oligonucleotide
  Target: FXN; (+) strand; PAM type: YTN; PAM sequence: CTC
agacacttttccttggatgt

SEQ ID NO: 31604 - DNA, 20 bp, Artificial Sequence
  Description of Artificial Sequence: Synthetic oligonucleotide
  Target: FXN; (+) strand; PAM type: YTN; PAM sequence: CTT
ttccttggatgttttgagca

SEQ ID NO: 31605 - DNA, 20 bp, Artificial Sequence
  Description of Artificial Sequence: Synthetic oligonucleotide
  Target: FXN; (+) strand; PAM type: YTN; PAM sequence: TTT
tccttggatgttttgagcac

SEQ ID NO: 31606 - DNA, 20 bp, Artificial Sequence
  Description of Artificial Sequence: Synthetic oligonucleotide
  Target: FXN; (+) strand; PAM type: YTN; PAM sequence: TTT
ccttggatgttttgagcact

SEQ ID NO: 31607 - DNA, 20 bp, Artificial Sequence
  Description of Artificial Sequence: Synthetic oligonucleotide
  Target: FXN; (+) strand; PAM type: YTN; PAM sequence: TTC
cttggatgttttgagcactg

SEQ ID NO: 31608 - DNA, 20 bp, Artificial Sequence
  Description of Artificial Sequence: Synthetic oligonucleotide
  Target: FXN; (+) strand; PAM type: YTN; PAM sequence: CTT
ggatgttttgagcactgctt

SEQ ID NO: 31609 - DNA, 20 bp, Artificial Sequence
  Description of Artificial Sequence: Synthetic oligonucleotide
  Target: FXN; (+) strand; PAM type: YTN; PAM sequence: TTG
gatgttttgagcactgcttt

SEQ ID NO: 31610 - DNA, 20 bp, Artificial Sequence
  Description of Artificial Sequence: Synthetic oligonucleotide
  Target: FXN; (+) strand; PAM type: YTN; PAM sequence: TTT
tgagcactgctttaattcct

SEQ ID NO: 31611 - DNA, 20 bp, Artificial Sequence
  Description of Artificial Sequence: Synthetic oligonucleotide
  Target: FXN; (+) strand; PAM type: YTN; PAM sequence: TTT
gagcactgctttaattcctg

SEQ ID NO: 31612 - DNA, 20 bp, Artificial Sequence
  Description of Artificial Sequence: Synthetic oligonucleotide
  Target: FXN; (+) strand; PAM type: YTN; PAM sequence: TTG
agcactgctttaattcctgg

SEQ ID NO: 31613 - DNA, 20 bp, Artificial Sequence
  Description of Artificial Sequence: Synthetic oligonucleotide
  Target: FXN; (+) strand; PAM type: YTN; PAM sequence: CTG
ctttaattcctgggaaaaca

SEQ ID NO: 31614 - DNA, 20 bp, Artificial Sequence
  Description of Artificial Sequence: Synthetic oligonucleotide
  Target: FXN; (+) strand; PAM type: YTN; PAM sequence: CTT
taattcctgggaaaacaatt

SEQ ID NO: 31615 - DNA, 20 bp, Artificial Sequence
  Description of Artificial Sequence: Synthetic oligonucleotide
  Target: FXN; (+) strand; PAM type: YTN; PAM sequence: TTT
aattcctgggaaaacaattc

SEQ ID NO: 31616 - DNA, 20 bp, Artificial Sequence
  Description of Artificial Sequence: Synthetic oligonucleotide
  Target: FXN; (+) strand; PAM type: YTN; PAM sequence: TTA
attcctgggaaaacaattcc

SEQ ID NO: 31617 - DNA, 20 bp, Artificial Sequence
  Description of Artificial Sequence: Synthetic oligonucleotide
  Target: FXN; (+) strand; PAM type: YTN; PAM sequence: TTC
ctgggaaaacaattccttcc

SEQ ID NO: 31618 - DNA, 20 bp, Artificial Sequence
  Description of Artificial Sequence: Synthetic oligonucleotide
  Target: FXN; (+) strand; PAM type: YTN; PAM sequence: CTG
ggaaaacaattccttccact

SEQ ID NO: 31619 - DNA, 20 bp, Artificial Sequence
  Description of Artificial Sequence: Synthetic oligonucleotide
  Target: FXN; (+) strand; PAM type: YTN; PAM sequence: TTC
cttccactgtgcacagactc

SEQ ID NO: 31620 - DNA, 20 bp, Artificial Sequence
  Description of Artificial Sequence: Synthetic oligonucleotide
  Target: FXN; (+) strand; PAM type: YTN; PAM sequence: CTT
ccactgtgcacagactctgg

SEQ ID NO: 31621 - DNA, 20 bp, Artificial Sequence
  Description of Artificial Sequence: Synthetic oligonucleotide
  Target: FXN; (+) strand; PAM type: YTN; PAM sequence: TTC
cactgtgcacagactctggg

SEQ ID NO: 31622 - DNA, 20 bp, Artificial Sequence
  Description of Artificial Sequence: Synthetic oligonucleotide
  Target: FXN; (+) strand; PAM type: YTN; PAM sequence: CTG
tgcacagactctggggccag

SEQ ID NO: 31623 - DNA, 20 bp, Artificial Sequence
  Description of Artificial Sequence: Synthetic oligonucleotide
  Target: FXN; (+) strand; PAM type: YTN; PAM sequence: CTC
tggggccagacagcttgggt

SEQ ID NO: 31624 - DNA, 20 bp, Artificial Sequence
  Description of Artificial Sequence: Synthetic oligonucleotide
  Target: FXN; (+) strand; PAM type: YTN; PAM sequence: CTG
gggccagacagcttgggttc

SEQ ID NO: 31625 - DNA, 20 bp, Artificial Sequence
  Description of Artificial Sequence: Synthetic oligonucleotide
  Target: FXN; (+) strand; PAM type: YTN; PAM sequence: CTT
gggttcaatcccagctctgc

SEQ ID NO: 31626 - DNA, 20 bp, Artificial Sequence
  Description of Artificial Sequence: Synthetic oligonucleotide
  Target: FXN; (+) strand; PAM type: YTN; PAM sequence: TTG
ggttcaatcccagctctgcc

SEQ ID NO: 31627 - DNA, 20 bp, Artificial Sequence
  Description of Artificial Sequence: Synthetic oligonucleotide
  Target: FXN; (+) strand; PAM type: YTN; PAM sequence: TTC
aatcccagctctgccactta

SEQ ID NO: 31628 - DNA, 20 bp, Artificial Sequence
  Description of Artificial Sequence: Synthetic oligonucleotide
  Target: FXN; (+) strand; PAM type: YTN; PAM sequence: CTC
tgccacttaatgtctgtgta

SEQ ID NO: 31629 - DNA, 20 bp, Artificial Sequence
  Description of Artificial Sequence: Synthetic oligonucleotide
  Target: FXN; (+) strand; PAM type: YTN; PAM sequence: CTG
ccacttaatgtctgtgtatc

SEQ ID NO: 31630 - DNA, 20 bp, Artificial Sequence
  Description of Artificial Sequence: Synthetic oligonucleotide
  Target: FXN; (+) strand; PAM type: YTN; PAM sequence: CTT
aatgtctgtgtatctgtgta

SEQ ID NO: 31631 - DNA, 20 bp, Artificial Sequence
  Description of Artificial Sequence: Synthetic oligonucleotide
  Target: FXN; (+) strand; PAM type: YTN; PAM sequence: TTA
atgtctgtgtatctgtgtag

SEQ ID NO: 31632 - DNA, 20 bp, Artificial Sequence
  Description of Artificial Sequence: Synthetic oligonucleotide
  Target: FXN; (+) strand; PAM type: YTN; PAM sequence: CTG
tgtatctgtgtaggcaagtt

SEQ ID NO: 31633 - DNA, 20 bp, Artificial Sequence
  Description of Artificial Sequence: Synthetic oligonucleotide
  Target: FXN; (+) strand; PAM type: YTN; PAM sequence: CTG
tgtaggcaagttaccctttg

SEQ ID NO: 31634 - DNA, 20 bp, Artificial Sequence
  Description of Artificial Sequence: Synthetic oligonucleotide
  Target: FXN; (+) strand; PAM type: YTN; PAM sequence: TTA
ccctttggtgcgtcagtttc

SEQ ID NO: 31635 - DNA, 20 bp, Artificial Sequence
  Description of Artificial Sequence: Synthetic oligonucleotide
  Target: FXN; (+) strand; PAM type: YTN; PAM sequence: CTT
tggtgcgtcagtttcctcat

SEQ ID NO: 31636 - DNA, 20 bp, Artificial Sequence
  Description of Artificial Sequence: Synthetic oligonucleotide
  Target: FXN; (+) strand; PAM type: YTN; PAM sequence: TTT
ggtgcgtcagtttcctcatc

SEQ ID NO: 31637 - DNA, 20 bp, Artificial Sequence
  Description of Artificial Sequence: Synthetic oligonucleotide
  Target: FXN; (+) strand; PAM type: YTN; PAM sequence: TTG
gtgcgtcagtttcctcatct

SEQ ID NO: 31638 - DNA, 20 bp, Artificial Sequence
  Description of Artificial Sequence: Synthetic oligonucleotide
  Target: FXN; (+) strand; PAM type: YTN; PAM sequence: TTT
cctcatctgtaaaacacaac

SEQ ID NO: 31639 - DNA, 20 bp, Artificial Sequence
  Description of Artificial Sequence: Synthetic oligonucleotide
  Target: FXN; (+) strand; PAM type: YTN; PAM sequence: TTC
ctcatctgtaaaacacaact

SEQ ID NO: 31640 - DNA, 20 bp, Artificial Sequence
  Description of Artificial Sequence: Synthetic oligonucleotide
  Target: FXN; (+) strand; PAM type: YTN; PAM sequence: CTC
atctgtaaaacacaactata

SEQ ID NO: 31641 - DNA, 20 bp, Artificial Sequence
  Description of Artificial Sequence: Synthetic oligonucleotide
  Target: FXN; (+) strand; PAM type: YTN; PAM sequence: CTG
taaaacacaactatagttga

SEQ ID NO: 31642 - DNA, 20 bp, Artificial Sequence
  Description of Artificial Sequence: Synthetic oligonucleotide
  Target: FXN; (+) strand; PAM type: YTN; PAM sequence: CTA
tagttgatcctcattcgtta

SEQ ID NO: 31643 - DNA, 20 bp, Artificial Sequence
  Description of Artificial Sequence: Synthetic oligonucleotide
  Target: FXN; (+) strand; PAM type: YTN; PAM sequence: TTG
atcctcattcgttaagagtc

SEQ ID NO: 31644 - DNA, 20 bp, Artificial Sequence
  Description of Artificial Sequence: Synthetic oligonucleotide
  Target: FXN; (+) strand; PAM type: YTN; PAM sequence: CTC
attcgttaagagtctgtact

SEQ ID NO: 31645 - DNA, 20 bp, Artificial Sequence
  Description of Artificial Sequence: Synthetic oligonucleotide
  Target: FXN; (+) strand; PAM type: YTN; PAM sequence: TTC
gttaagagtctgtacttgtt

SEQ ID NO: 31646 - DNA, 20 bp, Artificial Sequence
  Description of Artificial Sequence: Synthetic oligonucleotide
  Target: FXN; (+) strand; PAM type: YTN; PAM sequence: TTA
agagtctgtacttgttaatt

SEQ ID NO: 31647 - DNA, 20 bp, Artificial Sequence
  Description of Artificial Sequence: Synthetic oligonucleotide
  Target: FXN; (+) strand; PAM type: YTN; PAM sequence: CTG
tacttgttaatttgctcact

SEQ ID NO: 31648 - DNA, 20 bp, Artificial Sequence
  Description of Artificial Sequence: Synthetic oligonucleotide
  Target: FXN; (+) strand; PAM type: YTN; PAM sequence: CTT
gttaatttgctcacttgcta

SEQ ID NO: 31649 - DNA, 20 bp, Artificial Sequence
  Description of Artificial Sequence: Synthetic oligonucleotide
  Target: FXN; (+) strand; PAM type: YTN; PAM sequence: TTG
ttaatttgctcacttgctaa

SEQ ID NO: 31650 - DNA, 20 bp, Artificial Sequence
  Description of Artificial Sequence: Synthetic oligonucleotide
  Target: FXN; (+) strand; PAM type: YTN; PAM sequence: TTA
atttgctcacttgctaaaat

SEQ ID NO: 31651 - DNA, 20 bp, Artificial Sequence
  Description of Artificial Sequence: Synthetic oligonucleotide
  Target: FXN; (+) strand; PAM type: YTN; PAM sequence: TTT
gctcacttgctaaaatttgt

SEQ ID NO: 31652 - DNA, 20 bp, Artificial Sequence
  Description of Artificial Sequence: Synthetic oligonucleotide
  Target: FXN; (+) strand; PAM type: YTN; PAM sequence: TTG
ctcacttgctaaaatttgtt

SEQ ID NO: 31653 - DNA, 20 bp, Artificial Sequence
  Description of Artificial Sequence: Synthetic oligonucleotide
  Target: FXN; (+) strand; PAM type: YTN; PAM sequence: CTC
acttgctaaaatttgttacc

SEQ ID NO: 31654 - DNA, 20 bp, Artificial Sequence
  Description of Artificial Sequence: Synthetic oligonucleotide
  Target: FXN; (+) strand; PAM type: YTN; PAM sequence: CTT
gctaaaatttgttaccccaa

SEQ ID NO: 31655 - DNA, 20 bp, Artificial Sequence
  Description of Artificial Sequence: Synthetic oligonucleotide
  Target: FXN; (+) strand; PAM type: YTN; PAM sequence: TTG
ctaaaatttgttaccccaaa

SEQ ID NO: 31656 - DNA, 20 bp, Artificial Sequence
  Description of Artificial Sequence: Synthetic oligonucleotide
  Target: FXN; (+) strand; PAM type: YTN; PAM sequence: CTA
aaatttgttaccccaaaatc

SEQ ID NO: 31657 - DNA, 20 bp, Artificial Sequence
  Description of Artificial Sequence: Synthetic oligonucleotide
  Target: FXN; (+) strand; PAM type: YTN; PAM sequence: TTT
gttaccccaaaatcagtacc

SEQ ID NO: 31658 - DNA, 20 bp, Artificial Sequence
  Description of Artificial Sequence: Synthetic oligonucleotide
  Target: FXN; (+) strand; PAM type: YTN; PAM sequence: TTG
ttaccccaaaatcagtaccc

SEQ ID NO: 31659 - DNA, 20 bp, Artificial Sequence
  Description of Artificial Sequence: Synthetic oligonucleotide
  Target: FXN; (+) strand; PAM type: YTN; PAM sequence: TTA
ccccaaaatcagtaccccta

SEQ ID NO: 31660 - DNA, 20 bp, Artificial Sequence
  Description of Artificial Sequence: Synthetic oligonucleotide
  Target: FXN; (+) strand; PAM type: YTN; PAM sequence: CTA
gccttttggggtcgtttcaa

SEQ ID NO: 31661 - DNA, 20 bp, Artificial Sequence
  Description of Artificial Sequence: Synthetic oligonucleotide
  Target: FXN; (+) strand; PAM type: YTN; PAM sequence: CTT
ttggggtcgtttcaaagatg

SEQ ID NO: 31662 - DNA, 20 bp, Artificial Sequence
  Description of Artificial Sequence: Synthetic oligonucleotide
  Target: FXN; (+) strand; PAM type: YTN; PAM sequence: TTT
tggggtcgtttcaaagatgt

SEQ ID NO: 31663 - DNA, 20 bp, Artificial Sequence
  Description of Artificial Sequence: Synthetic oligonucleotide
  Target: FXN; (+) strand; PAM type: YTN; PAM sequence: TTT
ggggtcgtttcaaagatgtg

SEQ ID NO: 31664 - DNA, 20 bp, Artificial Sequence
  Description of Artificial Sequence: Synthetic oligonucleotide
  Target: FXN; (+) strand; PAM type: YTN; PAM sequence: TTG
gggtcgtttcaaagatgtgt

SEQ ID NO: 31665 - DNA, 20 bp, Artificial Sequence
  Description of Artificial Sequence: Synthetic oligonucleotide
  Target: FXN; (+) strand; PAM type: YTN; PAM sequence: TTT
caaagatgtgtgcagagcgg

SEQ ID NO: 31666 - DNA, 20 bp, Artificial Sequence
  Description of Artificial Sequence: Synthetic oligonucleotide
  Target: FXN; (+) strand; PAM type: YTN; PAM sequence: TTC
aaagatgtgtgcagagcggc

SEQ ID NO: 31667 - DNA, 20 bp, Artificial Sequence
  Description of Artificial Sequence: Synthetic oligonucleotide
  Target: FXN; (+) strand; PAM type: YTN; PAM sequence: CTC
ctccaggctcatgttcccag

SEQ ID NO: 31668 - DNA, 20 bp, Artificial Sequence
  Description of Artificial Sequence: Synthetic oligonucleotide
  Target: FXN; (+) strand; PAM type: YTN; PAM sequence: CTC
caggctcatgttcccagcca

SEQ ID NO: 31669 - DNA, 20 bp, Artificial Sequence
  Description of Artificial Sequence: Synthetic oligonucleotide
  Target: FXN; (+) strand; PAM type: YTN; PAM sequence: CTC
atgttcccagccaaggtcca

SEQ ID NO: 31670 - DNA, 20 bp, Artificial Sequence
  Description of Artificial Sequence: Synthetic oligonucleotide
  Target: FXN; (+) strand; PAM type: YTN; PAM sequence: TTC
ccagccaaggtccaacaaag

SEQ ID NO: 31671 - DNA, 20 bp, Artificial Sequence
  Description of Artificial Sequence: Synthetic oligonucleotide
  Target: FXN; (+) strand; PAM type: YTN; PAM sequence: CTG
ccctgccttcttatttcagc

SEQ ID NO: 31672 - DNA, 20 bp, Artificial Sequence
  Description of Artificial Sequence: Synthetic oligonucleotide
  Target: FXN; (+) strand; PAM type: YTN; PAM sequence: CTG
ccttcttatttcagctgtca

SEQ ID NO: 31673 - DNA, 20 bp, Artificial Sequence
  Description of Artificial Sequence: Synthetic oligonucleotide
  Target: FXN; (+) strand; PAM type: YTN; PAM sequence: CTT
cttatttcagctgtcatagt

SEQ ID NO: 31674 - DNA, 20 bp, Artificial Sequence
  Description of Artificial Sequence: Synthetic oligonucleotide
  Target: FXN; (+) strand; PAM type: YTN; PAM sequence: TTC
ttatttcagctgtcatagtg

SEQ ID NO: 31675 - DNA, 20 bp, Artificial Sequence
  Description of Artificial Sequence: Synthetic oligonucleotide
  Target: FXN; (+) strand; PAM type: YTN; PAM sequence: CTT
atttcagctgtcatagtgta

SEQ ID NO: 31676 - DNA, 20 bp, Artificial Sequence
  Description of Artificial Sequence: Synthetic oligonucleotide
  Target: FXN; (+) strand; PAM type: YTN; PAM sequence: TTA
tttcagctgtcatagtgtaa

SEQ ID NO: 31677 - DNA, 20 bp, Artificial Sequence
  Description of Artificial Sequence: Synthetic oligonucleotide
  Target: FXN; (+) strand; PAM type: YTN; PAM sequence: TTT
cagctgtcatagtgtaaact

SEQ ID NO: 31678 - DNA, 20 bp, Artificial Sequence
  Description of Artificial Sequence: Synthetic oligonucleotide
  Target: FXN; (+) strand; PAM type: YTN; PAM sequence: TTC
agctgtcatagtgtaaactg

SEQ ID NO: 31679 - DNA, 20 bp, Artificial Sequence
  Description of Artificial Sequence: Synthetic oligonucleotide
  Target: FXN; (+) strand; PAM type: YTN; PAM sequence: CTG
tcatagtgtaaactgtgtcc

SEQ ID NO: 31680 - DNA, 20 bp, Artificial Sequence
  Description of Artificial Sequence: Synthetic oligonucleotide
  Target: FXN; (+) strand; PAM type: YTN; PAM sequence: CTG
tgtccttttcacagtctgat

SEQ ID NO: 31681 - DNA, 20 bp, Artificial Sequence
  Description of Artificial Sequence: Synthetic oligonucleotide
  Target: FXN; (+) strand; PAM type: YTN; PAM sequence: CTT
ttcacagtctgattagtgcc

SEQ ID NO: 31682 - DNA, 20 bp, Artificial Sequence
  Description of Artificial Sequence: Synthetic oligonucleotide
  Target: FXN; (+) strand; PAM type: YTN; PAM sequence: TTT
tcacagtctgattagtgcca

SEQ ID NO: 31683 - DNA, 20 bp, Artificial Sequence
  Description of Artificial Sequence: Synthetic oligonucleotide
  Target: FXN; (+) strand; PAM type: YTN; PAM sequence: TTT
cacagtctgattagtgccat

SEQ ID NO: 31684 - DNA, 20 bp, Artificial Sequence
  Description of Artificial Sequence: Synthetic oligonucleotide
  Target: FXN; (+) strand; PAM type: YTN; PAM sequence: TTC
acagtctgattagtgccatg

SEQ ID NO: 31685 - DNA, 20 bp, Artificial Sequence
  Description of Artificial Sequence: Synthetic oligonucleotide
  Target: FXN; (+) strand; PAM type: YTN; PAM sequence: CTG
attagtgccatgtttttcag

SEQ ID NO: 31686 - DNA, 20 bp, Artificial Sequence
  Description of Artificial Sequence: Synthetic oligonucleotide
  Target: FXN; (+) strand; PAM type: YTN; PAM sequence: TTA
gtgccatgtttttcagattt

SEQ ID NO: 31687 - DNA, 20 bp, Artificial Sequence
  Description of Artificial Sequence: Synthetic oligonucleotide
  Target: FXN; (+) strand; PAM type: YTN; PAM sequence: TTT
ttcagatttttatgcttttt

SEQ ID NO: 31688 - DNA, 20 bp, Artificial Sequence
  Description of Artificial Sequence: Synthetic oligonucleotide
  Target: FXN; (+) strand; PAM type: YTN; PAM sequence: TTT
tcagatttttatgctttttt

SEQ ID NO: 31689 - DNA, 20 bp, Artificial Sequence
  Description of Artificial Sequence: Synthetic oligonucleotide
  Target: FXN; (+) strand; PAM type: YTN; PAM sequence: TTT
cagatttttatgcttttttc

SEQ ID NO: 31690 - DNA, 20 bp, Artificial Sequence
  Description of Artificial Sequence: Synthetic oligonucleotide
  Target: FXN; (+) strand; PAM type: YTN; PAM sequence: TTC
agatttttatgcttttttct

SEQ ID NO: 31691 - DNA, 20 bp, Artificial Sequence
  Description of Artificial Sequence: Synthetic oligonucleotide
  Target: FXN; (+) strand; PAM type: YTN; PAM sequence: TTT
ttatgcttttttcttggtta

SEQ ID NO: 31692 - DNA, 20 bp, Artificial Sequence
  Description of Artificial Sequence: Synthetic oligonucleotide
  Target: FXN; (+) strand; PAM type: YTN; PAM sequence: TTT
tatgcttttttcttggttat

SEQ ID NO: 31693 - DNA, 20 bp, Artificial Sequence
  Description of Artificial Sequence: Synthetic oligonucleotide
  Target: FXN; (+) strand; PAM type: YTN; PAM sequence: TTT
atgcttttttcttggttatt

SEQ ID NO: 31694 - DNA, 20 bp, Artificial Sequence
  Description of Artificial Sequence: Synthetic oligonucleotide
  Target: FXN; (+) strand; PAM type: YTN; PAM sequence: TTA
tgcttttttcttggttattt

SEQ ID NO: 31695 - DNA, 20 bp, Artificial Sequence
  Description of Artificial Sequence: Synthetic oligonucleotide
  Target: FXN; (+) strand; PAM type: YTN; PAM sequence: CTT
ttttcttggttatttctctg

SEQ ID NO: 31696 - DNA, 20 bp, Artificial Sequence
  Description of Artificial Sequence: Synthetic oligonucleotide
  Target: FXN; (+) strand; PAM type: YTN; PAM sequence: TTT
tttcttggttatttctctgt

SEQ ID NO: 31697 - DNA, 20 bp, Artificial Sequence
  Description of Artificial Sequence: Synthetic oligonucleotide
  Target: FXN; (+) strand; PAM type: YTN; PAM sequence: TTT
ttcttggttatttctctgtt

SEQ ID NO: 31698 - DNA, 20 bp, Artificial Sequence
  Description of Artificial Sequence: Synthetic oligonucleotide
  Target: FXN; (+) strand; PAM type: YTN; PAM sequence: TTT
tcttggttatttctctgtta

SEQ ID NO: 31699 - DNA, 20 bp, Artificial Sequence
  Description of Artificial Sequence: Synthetic oligonucleotide
  Target: FXN; (+) strand; PAM type: YTN; PAM sequence: TTT
cttggttatttctctgttaa

SEQ ID NO: 31700 - DNA, 20 bp, Artificial Sequence
  Description of Artificial Sequence: Synthetic oligonucleotide
  Target: FXN; (+) strand; PAM type: YTN; PAM sequence: TTC
ttggttatttctctgttaaa

SEQ ID NO: 31701 - DNA, 20 bp, Artificial Sequence
  Description of Artificial Sequence: Synthetic oligonucleotide
  Target: FXN; (+) strand; PAM type: YTN; PAM sequence: CTT
ggttatttctctgttaaaat

SEQ ID NO: 31702 - DNA, 20 bp, Artificial Sequence
  Description of Artificial Sequence: Synthetic oligonucleotide
  Target: FXN; (+) strand; PAM type: YTN; PAM sequence: TTG
gttatttctctgttaaaatt

SEQ ID NO: 31703 - DNA, 20 bp, Artificial Sequence
  Description of Artificial Sequence: Synthetic oligonucleotide
  Target: FXN; (+) strand; PAM type: YTN; PAM sequence: TTA
tttctctgttaaaattgtct

SEQ ID NO: 31704 - DNA, 20 bp, Artificial Sequence
  Description of Artificial Sequence: Synthetic oligonucleotide
  Target: FXN; (+) strand; PAM type: YTN; PAM sequence: TTT
ctctgttaaaattgtctcca

SEQ ID NO: 31705 - DNA, 20 bp, Artificial Sequence
  Description of Artificial Sequence: Synthetic oligonucleotide
  Target: FXN; (+) strand; PAM type: YTN; PAM sequence: TTC
tctgttaaaattgtctccaa

SEQ ID NO: 31706 - DNA, 20 bp, Artificial Sequence
  Description of Artificial Sequence: Synthetic oligonucleotide
  Target: FXN; (+) strand; PAM type: YTN; PAM sequence: CTC
tgttaaaattgtctccaagt

SEQ ID NO: 31707 - DNA, 20 bp, Artificial Sequence
  Description of Artificial Sequence: Synthetic oligonucleotide
  Target: FXN; (+) strand; PAM type: YTN; PAM sequence: CTG
ttaaaattgtctccaagtgt

SEQ ID NO: 31708 - DNA, 20 bp, Artificial Sequence
  Description of Artificial Sequence: Synthetic oligonucleotide
  Target: FXN; (+) strand; PAM type: YTN; PAM sequence: TTA
aaattgtctccaagtgtagt

SEQ ID NO: 31709 - DNA, 20 bp, Artificial Sequence
  Description of Artificial Sequence: Synthetic oligonucleotide
  Target: FXN; (+) strand; PAM type: YTN; PAM sequence: TTG
tctccaagtgtagtgcaaag

SEQ ID NO: 31710 - DNA, 20 bp, Artificial Sequence
  Description of Artificial Sequence: Synthetic oligonucleotide
  Target: FXN; (+) strand; PAM type: YTN; PAM sequence: CTC
caagtgtagtgcaaagttta

SEQ ID NO: 31711 - DNA, 20 bp, Artificial Sequence
  Description of Artificial Sequence: Synthetic oligonucleotide
  Target: FXN; (+) strand; PAM type: YTN; PAM sequence: TTT
agcacgaggaggctgtgatg

SEQ ID NO: 31712 - DNA, 20 bp, Artificial Sequence
  Description of Artificial Sequence: Synthetic oligonucleotide
  Target: FXN; (+) strand; PAM type: YTN; PAM sequence: TTA
gcacgaggaggctgtgatgt

SEQ ID NO: 31713 - DNA, 20 bp, Artificial Sequence
  Description of Artificial Sequence: Synthetic oligonucleotide
  Target: FXN; (+) strand; PAM type: YTN; PAM sequence: CTG
tgatgttccttacagagaaa

SEQ ID NO: 31714 - DNA, 20 bp, Artificial Sequence
  Description of Artificial Sequence: Synthetic oligonucleotide
  Target: FXN; (+) strand; PAM type: YTN; PAM sequence: TTC
cttacagagaaaatgcatgt

SEQ ID NO: 31715 - DNA, 20 bp, Artificial Sequence
  Description of Artificial Sequence: Synthetic oligonucleotide
  Target: FXN; (+) strand; PAM type: YTN; PAM sequence: CTT
acagagaaaatgcatgtgtt

SEQ ID NO: 31716 - DNA, 20 bp, Artificial Sequence
  Description of Artificial Sequence: Synthetic oligonucleotide
  Target: FXN; (+) strand; PAM type: YTN; PAM sequence: TTA
cagagaaaatgcatgtgtta

SEQ ID NO: 31717 - DNA, 20 bp, Artificial Sequence
  Description of Artificial Sequence: Synthetic oligonucleotide
  Target: FXN; (+) strand; PAM type: YTN; PAM sequence: TTA
gagaagctttgtcaggcatg

SEQ ID NO: 31718 - DNA, 20 bp, Artificial Sequence
  Description of Artificial Sequence: Synthetic oligonucleotide
  Target: FXN; (+) strand; PAM type: YTN; PAM sequence: CTT
tgtcaggcatgagttaaggt

SEQ ID NO: 31719 - DNA, 20 bp, Artificial Sequence
  Description of Artificial Sequence: Synthetic oligonucleotide
  Target: FXN; (+) strand; PAM type: YTN; PAM sequence: TTT
gtcaggcatgagttaaggtg

SEQ ID NO: 31720 - DNA, 20 bp, Artificial Sequence
  Description of Artificial Sequence: Synthetic oligonucleotide
  Target: FXN; (+) strand; PAM type: YTN; PAM sequence: TTG
tcaggcatgagttaaggtgc

SEQ ID NO: 31721 - DNA, 20 bp, Artificial Sequence
  Description of Artificial Sequence: Synthetic oligonucleotide
  Target: FXN; (+) strand; PAM type: YTN; PAM sequence: TTA
aggtgctgttgtcctgagat

SEQ ID NO: 31722 - DNA, 20 bp, Artificial Sequence
  Description of Artificial Sequence: Synthetic oligonucleotide
  Target: FXN; (+) strand; PAM type: YTN; PAM sequence: CTG
ttgtcctgagatcaattaat

SEQ ID NO: 31723 - DNA, 20 bp, Artificial Sequence
  Description of Artificial Sequence: Synthetic oligonucleotide
  Target: FXN; (+) strand; PAM type: YTN; PAM sequence: TTG
tcctgagatcaattaatttg

SEQ ID NO: 31724 - DNA, 20 bp, Artificial Sequence
  Description of Artificial Sequence: Synthetic oligonucleotide
  Target: FXN; (+) strand; PAM type: YTN; PAM sequence: CTG
agatcaattaatttgttgtt

SEQ ID NO: 31725 - DNA, 20 bp, Artificial Sequence
  Description of Artificial Sequence: Synthetic oligonucleotide
  Target: FXN; (+) strand; PAM type: YTN; PAM sequence: TTA
atttgttgttgttgttgttt

SEQ ID NO: 31726 - DNA, 20 bp, Artificial Sequence
  Description of Artificial Sequence: Synthetic oligonucleotide
  Target: FXN; (+) strand; PAM type: YTN; PAM sequence: TTT
gttgttgttgttgtttgaga

SEQ ID NO: 31727 - DNA, 20 bp, Artificial Sequence
  Description of Artificial Sequence: Synthetic oligonucleotide
  Target: FXN; (+) strand; PAM type: YTN; PAM sequence: TTG
ttgttgttgttgtttgagac

SEQ ID NO: 31728 - DNA, 20 bp, Artificial Sequence
  Description of Artificial Sequence: Synthetic oligonucleotide
  Target: FXN; (+) strand; PAM type: YTN; PAM sequence: TTG
ttgttgttgtttgagacagg

SEQ ID NO: 31729 - DNA, 20 bp, Artificial Sequence
  Description of Artificial Sequence: Synthetic oligonucleotide
  Target: FXN; (+) strand; PAM type: YTN; PAM sequence: TTG
ttgttgtttgagacagggtc

SEQ ID NO: 31730 - DNA, 20 bp, Artificial Sequence
  Description of Artificial Sequence: Synthetic oligonucleotide
  Target: FXN; (+) strand; PAM type: YTN; PAM sequence: TTG
ttgtttgagacagggtctcc

SEQ ID NO: 31731 - DNA, 20 bp, Artificial Sequence
  Description of Artificial Sequence: Synthetic oligonucleotide
  Target: FXN; (+) strand; PAM type: YTN; PAM sequence: TTG
tttgagacagggtctccctc

SEQ ID NO: 31732 - DNA, 20 bp, Artificial Sequence
  Description of Artificial Sequence: Synthetic oligonucleotide
  Target: FXN; (+) strand; PAM type: YTN; PAM sequence: TTT
gagacagggtctccctctgt

SEQ ID NO: 31733 - DNA, 20 bp, Artificial Sequence
  Description of Artificial Sequence: Synthetic oligonucleotide
  Target: FXN; (+) strand; PAM type: YTN; PAM sequence: TTG
agacagggtctccctctgtt

SEQ ID NO: 31734 - DNA, 20 bp, Artificial Sequence
  Description of Artificial Sequence: Synthetic oligonucleotide
  Target: FXN; (+) strand; PAM type: YTN; PAM sequence: CTC
cctctgttgcccaggctgct

SEQ ID NO: 31735 - DNA, 20 bp, Artificial Sequence
  Description of Artificial Sequence: Synthetic oligonucleotide
  Target: FXN; (+) strand; PAM type: YTN; PAM sequence: CTC
tgttgcccaggctgctggag

SEQ ID NO: 31736 - DNA, 20 bp, Artificial Sequence
  Description of Artificial Sequence: Synthetic oligonucleotide
  Target: FXN; (+) strand; PAM type: YTN; PAM sequence: CTG
ttgcccaggctgctggagtg

SEQ ID NO: 31737 - DNA, 20 bp, Artificial Sequence
  Description of Artificial Sequence: Synthetic oligonucleotide
  Target: FXN; (+) strand; PAM type: YTN; PAM sequence: TTG
cccaggctgctggagtgcaa

SEQ ID NO: 31738 - DNA, 20 bp, Artificial Sequence
  Description of Artificial Sequence: Synthetic oligonucleotide
  Target: FXN; (+) strand; PAM type: YTN; PAM sequence: CTG
ctggagtgcaatggtgtaat

SEQ ID NO: 31739 - DNA, 20 bp, Artificial Sequence
  Description of Artificial Sequence: Synthetic oligonucleotide
  Target: FXN; (+) strand; PAM type: YTN; PAM sequence: CTG
gagtgcaatggtgtaatcat

SEQ ID NO: 31740 - DNA, 20 bp, Artificial Sequence
  Description of Artificial Sequence: Synthetic oligonucleotide
  Target: FXN; (+) strand; PAM type: YTN; PAM sequence: CTC
actgcagcctctacctctct

SEQ ID NO: 31741 - DNA, 20 bp, Artificial Sequence
  Description of Artificial Sequence: Synthetic oligonucleotide
  Target: FXN; (+) strand; PAM type: YTN; PAM sequence: CTG
cagcctctacctctctggct

SEQ ID NO: 31742 - DNA, 20 bp, Artificial Sequence
  Description of Artificial Sequence: Synthetic oligonucleotide
  Target: FXN; (+) strand; PAM type: YTN; PAM sequence: CTC
tacctctctggctcaagcaa

SEQ ID NO: 31743 - DNA, 20 bp, Artificial Sequence
  Description of Artificial Sequence: Synthetic oligonucleotide
  Target: FXN; (+) strand; PAM type: YTN; PAM sequence: CTA
cctctctggctcaagcaatc

SEQ ID NO: 31744 - DNA, 20 bp, Artificial Sequence
  Description of Artificial Sequence: Synthetic oligonucleotide
  Target: FXN; (+) strand; PAM type: YTN; PAM sequence: CTC
tctggctcaagcaatcctcc

SEQ ID NO: 31745 - DNA, 20 bp, Artificial Sequence
  Description of Artificial Sequence: Synthetic oligonucleotide
  Target: FXN; (+) strand; PAM type: YTN; PAM sequence: CTC
tggctcaagcaatcctccca

SEQ ID NO: 31746 - DNA, 20 bp, Artificial Sequence
  Description of Artificial Sequence: Synthetic oligonucleotide
  Target: FXN; (+) strand; PAM type: YTN; PAM sequence: CTG
gctcaagcaatcctcccacc

SEQ ID NO: 31747 - DNA, 20 bp, Artificial Sequence
  Description of Artificial Sequence: Synthetic oligonucleotide
  Target: FXN; (+) strand; PAM type: YTN; PAM sequence: CTC
aagcaatcctcccacctcgg

SEQ ID NO: 31748 - DNA, 20 bp, Artificial Sequence
  Description of Artificial Sequence: Synthetic oligonucleotide
  Target: FXN; (+) strand; PAM type: YTN; PAM sequence: CTC
ccacctcggcctcctgagta

SEQ ID NO: 31749 - DNA, 20 bp, Artificial Sequence
  Description of Artificial Sequence: Synthetic oligonucleotide
  Target: FXN; (+) strand; PAM type: YTN; PAM sequence: CTC
ggcctcctgagtagctggga

SEQ ID NO: 31750 - DNA, 20 bp, Artificial Sequence
  Description of Artificial Sequence: Synthetic oligonucleotide
  Target: FXN; (+) strand; PAM type: YTN; PAM sequence: CTC
ctgagtagctgggactacag

SEQ ID NO: 31751 - DNA, 20 bp, Artificial Sequence
  Description of Artificial Sequence: Synthetic oligonucleotide
  Target: FXN; (+) strand; PAM type: YTN; PAM sequence: CTG
agtagctgggactacaggta

SEQ ID NO: 31752 - DNA, 20 bp, Artificial Sequence
  Description of Artificial Sequence: Synthetic oligonucleotide
  Target: FXN; (+) strand; PAM type: YTN; PAM sequence: CTG
ggactacaggtacaccccac

SEQ ID NO: 31753 - DNA, 20 bp, Artificial Sequence
  Description of Artificial Sequence: Synthetic oligonucleotide
  Target: FXN; (+) strand; PAM type: YTN; PAM sequence: CTA
caggtacaccccaccacacc

SEQ ID NO: 31754 - DNA, 20 bp, Artificial Sequence
  Description of Artificial Sequence: Synthetic oligonucleotide
  Target: FXN; (+) strand; PAM type: YTN; PAM sequence: TTT
ttgatatttttttaggtgga

SEQ ID NO: 31755 - DNA, 20 bp, Artificial Sequence
  Description of Artificial Sequence: Synthetic oligonucleotide
  Target: FXN; (+) strand; PAM type: YTN; PAM sequence: TTT
tgatatttttttaggtggaa

SEQ ID NO: 31756 - DNA, 20 bp, Artificial Sequence
  Description of Artificial Sequence: Synthetic oligonucleotide
  Target: FXN; (+) strand; PAM type: YTN; PAM sequence: TTT
gatatttttttaggtggaat

SEQ ID NO: 31757 - DNA, 20 bp, Artificial Sequence
  Description of Artificial Sequence: Synthetic oligonucleotide
  Target: FXN; (+) strand; PAM type: YTN; PAM sequence: TTG
atatttttttaggtggaatt

SEQ ID NO: 31758 - DNA, 20 bp, Artificial Sequence
  Description of Artificial Sequence: Synthetic oligonucleotide
  Target: FXN; (+) strand; PAM type: YTN; PAM sequence: TTT
ttttaggtggaattttgctc

SEQ ID NO: 31759 - DNA, 20 bp, Artificial Sequence
  Description of Artificial Sequence: Synthetic oligonucleotide
  Target: FXN; (+) strand; PAM type: YTN; PAM sequence: TTT
tttaggtggaattttgctca

SEQ ID NO: 31760 - DNA, 20 bp, Artificial Sequence
  Description of Artificial Sequence: Synthetic oligonucleotide
  Target: FXN; (+) strand; PAM type: YTN; PAM sequence: TTT
ttaggtggaattttgctcat

SEQ ID NO: 31761 - DNA, 20 bp, Artificial Sequence
  Description of Artificial Sequence: Synthetic oligonucleotide
  Target: FXN; (+) strand; PAM type: YTN; PAM sequence: TTT
taggtggaattttgctcatc

SEQ ID NO: 31762 - DNA, 20 bp, Artificial Sequence
  Description of Artificial Sequence: Synthetic oligonucleotide
  Target: FXN; (+) strand; PAM type: YTN; PAM sequence: TTT
aggtggaattttgctcatca

SEQ ID NO: 31763 - DNA, 20 bp, Artificial Sequence
  Description of Artificial Sequence: Synthetic oligonucleotide
  Target: FXN; (+) strand; PAM type: YTN; PAM sequence: TTA
ggtggaattttgctcatcac

SEQ ID NO: 31764 - DNA, 20 bp, Artificial Sequence
  Description of Artificial Sequence: Synthetic oligonucleotide
  Target: FXN; (+) strand; PAM type: YTN; PAM sequence: TTT
tgctcatcacccaggctgga

SEQ ID NO: 31765 - DNA, 20 bp, Artificial Sequence
  Description of Artificial Sequence: Synthetic oligonucleotide
  Target: FXN; (+) strand; PAM type: YTN; PAM sequence: TTT
gctcatcacccaggctggag

SEQ ID NO: 31766 - DNA, 20 bp, Artificial Sequence
  Description of Artificial Sequence: Synthetic oligonucleotide
  Target: FXN; (+) strand; PAM type: YTN; PAM sequence: TTG
ctcatcacccaggctggagt

SEQ ID NO: 31767 - DNA, 20 bp, Artificial Sequence
  Description of Artificial Sequence: Synthetic oligonucleotide
  Target: FXN; (+) strand; PAM type: YTN; PAM sequence: CTC
atcacccaggctggagtgca

SEQ ID NO: 31768 - DNA, 20 bp, Artificial Sequence
  Description of Artificial Sequence: Synthetic oligonucleotide
  Target: FXN; (+) strand; PAM type: YTN; PAM sequence: CTG
gagtgcaatggtgcgatcct

SEQ ID NO: 31769 - DNA, 20 bp, Artificial Sequence
  Description of Artificial Sequence: Synthetic oligonucleotide
  Target: FXN; (+) strand; PAM type: YTN; PAM sequence: CTG
gctcactgcaacctccacct

SEQ ID NO: 31770 - DNA, 20 bp, Artificial Sequence
  Description of Artificial Sequence: Synthetic oligonucleotide
  Target: FXN; (+) strand; PAM type: YTN; PAM sequence: CTC
actgcaacctccacctcccg

SEQ ID NO: 31771 - DNA, 20 bp, Artificial Sequence
  Description of Artificial Sequence: Synthetic oligonucleotide
  Target: FXN; (+) strand; PAM type: YTN; PAM sequence: CTG
caacctccacctcccggatt

SEQ ID NO: 31772 - DNA, 20 bp, Artificial Sequence
  Description of Artificial Sequence: Synthetic oligonucleotide
  Target: FXN; (+) strand; PAM type: YTN; PAM sequence: CTC
cacctcccggattcaagcaa

SEQ ID NO: 31773 - DNA, 20 bp, Artificial Sequence
  Description of Artificial Sequence: Synthetic oligonucleotide
  Target: FXN; (+) strand; PAM type: YTN; PAM sequence: CTC
ccggattcaagcaattcttc

SEQ ID NO: 31774 - DNA, 20 bp, Artificial Sequence
  Description of Artificial Sequence: Synthetic oligonucleotide
  Target: FXN; (+) strand; PAM type: YTN; PAM sequence: TTC
aagcaattcttctgcctcag

SEQ ID NO: 31775 - DNA, 20 bp, Artificial Sequence
  Description of Artificial Sequence: Synthetic oligonucleotide
  Target: FXN; (+) strand; PAM type: YTN; PAM sequence: TTC
ttctgcctcagcctcctgag

SEQ ID NO: 31776 - DNA, 20 bp, Artificial Sequence
  Description of Artificial Sequence: Synthetic oligonucleotide
  Target: FXN; (+) strand; PAM type: YTN; PAM sequence: CTT
ctgcctcagcctcctgagta

SEQ ID NO: 31777 - DNA, 20 bp, Artificial Sequence
  Description of Artificial Sequence: Synthetic oligonucleotide
  Target: FXN; (+) strand; PAM type: YTN; PAM sequence: TTC
tgcctcagcctcctgagtag

SEQ ID NO: 31778 - DNA, 20 bp, Artificial Sequence
  Description of Artificial Sequence: Synthetic oligonucleotide
  Target: FXN; (+) strand; PAM type: YTN; PAM sequence: CTG
cctcagcctcctgagtagca

SEQ ID NO: 31779 - DNA, 20 bp, Artificial Sequence
  Description of Artificial Sequence: Synthetic oligonucleotide
  Target: FXN; (+) strand; PAM type: YTN; PAM sequence: CTC
agcctcctgagtagcacaga

SEQ ID NO: 31780 - DNA, 20 bp, Artificial Sequence
  Description of Artificial Sequence: Synthetic oligonucleotide
  Target: FXN; (+) strand; PAM type: YTN; PAM sequence: CTC
ctgagtagcacagattacag

SEQ ID NO: 31781 - DNA, 20 bp, Artificial Sequence
  Description of Artificial Sequence: Synthetic oligonucleotide
  Target: FXN; (+) strand; PAM type: YTN; PAM sequence: CTG
agtagcacagattacaggca

SEQ ID NO: 31782 - DNA, 20 bp, Artificial Sequence
  Description of Artificial Sequence: Synthetic oligonucleotide
  Target: FXN; (+) strand; PAM type: YTN; PAM sequence: TTA
caggcacatgtcatcacgcc

SEQ ID NO: 31783 - DNA, 20 bp, Artificial Sequence
  Description of Artificial Sequence: Synthetic oligonucleotide
  Target: FXN; (+) strand; PAM type: YTN; PAM sequence: CTT
gctaatttttgtgtttttag

SEQ ID NO: 31784 - DNA, 20 bp, Artificial Sequence
  Description of Artificial Sequence: Synthetic oligonucleotide
  Target: FXN; (+) strand; PAM type: YTN; PAM sequence: TTG
ctaatttttgtgtttttagt

SEQ ID NO: 31785 - DNA, 20 bp, Artificial Sequence
  Description of Artificial Sequence: Synthetic oligonucleotide
  Target: FXN; (+) strand; PAM type: YTN; PAM sequence: CTA
atttttgtgtttttagtaga

SEQ ID NO: 31786 - DNA, 20 bp, Artificial Sequence
  Description of Artificial Sequence: Synthetic oligonucleotide
  Target: FXN; (+) strand; PAM type: YTN; PAM sequence: TTT
ttgtgtttttagtagaggcg

SEQ ID NO: 31787 - DNA, 20 bp, Artificial Sequence
  Description of Artificial Sequence: Synthetic oligonucleotide
  Target: FXN; (+) strand; PAM type: YTN; PAM sequence: TTT
tgtgtttttagtagaggcgg

SEQ ID NO: 31788 - DNA, 20 bp, Artificial Sequence
  Description of Artificial Sequence: Synthetic oligonucleotide
  Target: FXN; (+) strand; PAM type: YTN; PAM sequence: TTT
gtgtttttagtagaggcggg

SEQ ID NO: 31789 - DNA, 20 bp, Artificial Sequence
  Description of Artificial Sequence: Synthetic oligonucleotide
  Target: FXN; (+) strand; PAM type: YTN; PAM sequence: TTG
tgtttttagtagaggcgggg

SEQ ID NO: 31790 - DNA, 20 bp, Artificial Sequence
  Description of Artificial Sequence: Synthetic oligonucleotide
  Target: FXN; (+) strand; PAM type: YTN; PAM sequence: TTT
ttagtagaggcggggtttca

SEQ ID NO: 31791 - DNA, 20 bp, Artificial Sequence
  Description of Artificial Sequence: Synthetic oligonucleotide
  Target: FXN; (+) strand; PAM type: YTN; PAM sequence: TTT
tagtagaggcggggtttcac

SEQ ID NO: 31792 - DNA, 20 bp, Artificial Sequence
  Description of Artificial Sequence: Synthetic oligonucleotide
  Target: FXN; (+) strand; PAM type: YTN; PAM sequence: TTT
agtagaggcggggtttcacc

SEQ ID NO: 31793 - DNA, 20 bp, Artificial Sequence
  Description of Artificial Sequence: Synthetic oligonucleotide
  Target: FXN; (+) strand; PAM type: YTN; PAM sequence: TTA
gtagaggcggggtttcacca

SEQ ID NO: 31794 - DNA, 20 bp, Artificial Sequence
  Description of Artificial Sequence: Synthetic oligonucleotide
  Target: FXN; (+) strand; PAM type: YTN; PAM sequence: TTT
caccatgttggccaggctag

SEQ ID NO: 31795 - DNA, 20 bp, Artificial Sequence
  Description of Artificial Sequence: Synthetic oligonucleotide
  Target: FXN; (+) strand; PAM type: YTN; PAM sequence: TTC
accatgttggccaggctagt

SEQ ID NO: 31796 - DNA, 20 bp, Artificial Sequence
  Description of Artificial Sequence: Synthetic oligonucleotide
  Target: FXN; (+) strand; PAM type: YTN; PAM sequence: TTG
gccaggctagtcttgaactc

SEQ ID NO: 31797 - DNA, 20 bp, Artificial Sequence
  Description of Artificial Sequence: Synthetic oligonucleotide
  Target: FXN; (+) strand; PAM type: YTN; PAM sequence: CTA
gtcttgaactcctgacctca

SEQ ID NO: 31798 - DNA, 20 bp, Artificial Sequence
  Description of Artificial Sequence: Synthetic oligonucleotide
  Target: FXN; (+) strand; PAM type: YTN; PAM sequence: CTT
gaactcctgacctcaggtga

SEQ ID NO: 31799 - DNA, 20 bp, Artificial Sequence
  Description of Artificial Sequence: Synthetic oligonucleotide
  Target: FXN; (+) strand; PAM type: YTN; PAM sequence: TTG
aactcctgacctcaggtgat

SEQ ID NO: 31800 - DNA, 20 bp, Artificial Sequence
  Description of Artificial Sequence: Synthetic oligonucleotide
  Target: FXN; (+) strand; PAM type: YTN; PAM sequence: CTC
ctgacctcaggtgatccacc

SEQ ID NO: 31801 - DNA, 20 bp, Artificial Sequence
  Description of Artificial Sequence: Synthetic oligonucleotide
  Target: FXN; (+) strand; PAM type: YTN; PAM sequence: CTG
acctcaggtgatccacccgc

SEQ ID NO: 31802 - DNA, 20 bp, Artificial Sequence
  Description of Artificial Sequence: Synthetic oligonucleotide
  Target: FXN; (+) strand; PAM type: YTN; PAM sequence: CTC
aggtgatccacccgcctccg

SEQ ID NO: 31803 - DNA, 20 bp, Artificial Sequence
  Description of Artificial Sequence: Synthetic oligonucleotide
  Target: FXN; (+) strand; PAM type: YTN; PAM sequence: CTC
cgcctcccaaactgcagaga

SEQ ID NO: 31804 - DNA, 20 bp, Artificial Sequence
  Description of Artificial Sequence: Synthetic oligonucleotide
  Target: FXN; (+) strand; PAM type: YTN; PAM sequence: CTC
ccaaactgcagagattatag

SEQ ID NO: 31805 - DNA, 20 bp, Artificial Sequence
  Description of Artificial Sequence: Synthetic oligonucleotide
  Target: FXN; (+) strand; PAM type: YTN; PAM sequence: CTG
cagagattataggcacgaac

SEQ ID NO: 31806 - DNA, 20 bp, Artificial Sequence
  Description of Artificial Sequence: Synthetic oligonucleotide
  Target: FXN; (+) strand; PAM type: YTN; PAM sequence: TTA
taggcacgaaccacaatgcc

SEQ ID NO: 31807 - DNA, 20 bp, Artificial Sequence
  Description of Artificial Sequence: Synthetic oligonucleotide
  Target: FXN; (+) strand; PAM type: YTN; PAM sequence: CTC
atgttttttatttttcaagt

SEQ ID NO: 31808 - DNA, 20 bp, Artificial Sequence
  Description of Artificial Sequence: Synthetic oligonucleotide
  Target: FXN; (+) strand; PAM type: YTN; PAM sequence: TTT
tttatttttcaagttgaaat

SEQ ID NO: 31809 - DNA, 20 bp, Artificial Sequence
  Description of Artificial Sequence: Synthetic oligonucleotide
  Target: FXN; (+) strand; PAM type: YTN; PAM sequence: TTT
ttatttttcaagttgaaatg

SEQ ID NO: 31810 - DNA, 20 bp, Artificial Sequence
  Description of Artificial Sequence: Synthetic oligonucleotide
  Target: FXN; (+) strand; PAM type: YTN; PAM sequence: TTT
tatttttcaagttgaaatga

SEQ ID NO: 31811 - DNA, 20 bp, Artificial Sequence
  Description of Artificial Sequence: Synthetic oligonucleotide
  Target: FXN; (+) strand; PAM type: YTN; PAM sequence: TTT
atttttcaagttgaaatgag

SEQ ID NO: 31812 - DNA, 20 bp, Artificial Sequence
  Description of Artificial Sequence: Synthetic oligonucleotide
  Target: FXN; (+) strand; PAM type: YTN; PAM sequence: TTA
tttttcaagttgaaatgagg

SEQ ID NO: 31813 - DNA, 20 bp, Artificial Sequence
  Description of Artificial Sequence: Synthetic oligonucleotide
  Target: FXN; (+) strand; PAM type: YTN; PAM sequence: TTT
ttcaagttgaaatgaggtct

SEQ ID NO: 31814 - DNA, 20 bp, Artificial Sequence
  Description of Artificial Sequence: Synthetic oligonucleotide
  Target: FXN; (+) strand; PAM type: YTN; PAM sequence: TTT
tcaagttgaaatgaggtctc

SEQ ID NO: 31815 - DNA, 20 bp, Artificial Sequence
  Description of Artificial Sequence: Synthetic oligonucleotide
  Target: FXN; (+) strand; PAM type: YTN; PAM sequence: TTT
caagttgaaatgaggtctct

SEQ ID NO: 31816 - DNA, 20 bp, Artificial Sequence
  Description of Artificial Sequence: Synthetic oligonucleotide
  Target: FXN; (+) strand; PAM type: YTN; PAM sequence: TTC
aagttgaaatgaggtctctc

SEQ ID NO: 31817 - DNA, 20 bp, Artificial Sequence
  Description of Artificial Sequence: Synthetic oligonucleotide
  Target: FXN; (+) strand; PAM type: YTN; PAM sequence: TTG
aaatgaggtctctctatgtt

SEQ ID NO: 31818 - DNA, 20 bp, Artificial Sequence
  Description of Artificial Sequence: Synthetic oligonucleotide
  Target: FXN; (+) strand; PAM type: YTN; PAM sequence: CTC
tctatgttgcccaggttggt

SEQ ID NO: 31819 - DNA, 20 bp, Artificial Sequence
  Description of Artificial Sequence: Synthetic oligonucleotide
  Target: FXN; (+) strand; PAM type: YTN; PAM sequence: CTC
tatgttgcccaggttggtct

SEQ ID NO: 31820 - DNA, 20 bp, Artificial Sequence
  Description of Artificial Sequence: Synthetic oligonucleotide
  Target: FXN; (+) strand; PAM type: YTN; PAM sequence: CTA
tgttgcccaggttggtctca

SEQ ID NO: 31821 - DNA, 20 bp, Artificial Sequence
  Description of Artificial Sequence: Synthetic oligonucleotide
  Target: FXN; (+) strand; PAM type: YTN; PAM sequence: TTG
cccaggttggtctcaaactc

SEQ ID NO: 31822 - DNA, 20 bp, Artificial Sequence
  Description of Artificial Sequence: Synthetic oligonucleotide
  Target: FXN; (+) strand; PAM type: YTN; PAM sequence: TTG
gtctcaaactcttgagctca

SEQ ID NO: 31823 - DNA, 20 bp, Artificial Sequence
  Description of Artificial Sequence: Synthetic oligonucleotide
  Target: FXN; (+) strand; PAM type: YTN; PAM sequence: CTC
aaactcttgagctcaagtaa

SEQ ID NO: 31824 - DNA, 20 bp, Artificial Sequence
  Description of Artificial Sequence: Synthetic oligonucleotide
  Target: FXN; (+) strand; PAM type: YTN; PAM sequence: CTC
ttgagctcaagtaatcctcc

SEQ ID NO: 31825 - DNA, 20 bp, Artificial Sequence
  Description of Artificial Sequence: Synthetic oligonucleotide
  Target: FXN; (+) strand; PAM type: YTN; PAM sequence: CTT
gagctcaagtaatcctccca

SEQ ID NO: 31826 - DNA, 20 bp, Artificial Sequence
  Description of Artificial Sequence: Synthetic oligonucleotide
  Target: FXN; (+) strand; PAM type: YTN; PAM sequence: TTG
agctcaagtaatcctcccac

SEQ ID NO: 31827 - DNA, 20 bp, Artificial Sequence
  Description of Artificial Sequence: Synthetic oligonucleotide
  Target: FXN; (+) strand; PAM type: YTN; PAM sequence: CTC
aagtaatcctcccaccttgg

SEQ ID NO: 31828 - DNA, 20 bp, Artificial Sequence
  Description of Artificial Sequence: Synthetic oligonucleotide
  Target: FXN; (+) strand; PAM type: YTN; PAM sequence: CTC
ccaccttggcctcccaaagt

SEQ ID NO: 31829 - DNA, 20 bp, Artificial Sequence
  Description of Artificial Sequence: Synthetic oligonucleotide
  Target: FXN; (+) strand; PAM type: YTN; PAM sequence: CTT
ggcctcccaaagtgcgggga

SEQ ID NO: 31830 - DNA, 20 bp, Artificial Sequence
  Description of Artificial Sequence: Synthetic oligonucleotide
  Target: FXN; (+) strand; PAM type: YTN; PAM sequence: TTG
gcctcccaaagtgcggggat

SEQ ID NO: 31831 - DNA, 20 bp, Artificial Sequence
  Description of Artificial Sequence: Synthetic oligonucleotide
  Target: FXN; (+) strand; PAM type: YTN; PAM sequence: CTC
ccaaagtgcggggattacag

SEQ ID NO: 31832 - DNA, 20 bp, Artificial Sequence
  Description of Artificial Sequence: Synthetic oligonucleotide
  Target: FXN; (+) strand; PAM type: YTN; PAM sequence: TTA
caggtgtgagctaccatgcc

SEQ ID NO: 31833 - DNA, 20 bp, Artificial Sequence
  Description of Artificial Sequence: Synthetic oligonucleotide
  Target: FXN; (+) strand; PAM type: YTN; PAM sequence: CTA
ccatgcccagccaagatcag

SEQ ID NO: 31834 - DNA, 20 bp, Artificial Sequence
  Description of Artificial Sequence: Synthetic oligonucleotide
  Target: FXN; (+) strand; PAM type: YTN; PAM sequence: TTA
atgaatcaactatatatatt

SEQ ID NO: 31835 - DNA, 20 bp, Artificial Sequence
  Description of Artificial Sequence: Synthetic oligonucleotide
  Target: FXN; (+) strand; PAM type: YTN; PAM sequence: CTA
tatatattacataaggtgtc

SEQ ID NO: 31836 - DNA, 20 bp, Artificial Sequence
  Description of Artificial Sequence: Synthetic oligonucleotide
  Target: FXN; (+) strand; PAM type: YTN; PAM sequence: TTA
cataaggtgtctttaaacag

SEQ ID NO: 31837 - DNA, 20 bp, Artificial Sequence
  Description of Artificial Sequence: Synthetic oligonucleotide
  Target: FXN; (+) strand; PAM type: YTN; PAM sequence: CTT
taaacagaaataaggttata

SEQ ID NO: 31838 - DNA, 20 bp, Artificial Sequence
  Description of Artificial Sequence: Synthetic oligonucleotide
  Target: FXN; (+) strand; PAM type: YTN; PAM sequence: TTT
aaacagaaataaggttatat

SEQ ID NO: 31839 - DNA, 20 bp, Artificial Sequence
  Description of Artificial Sequence: Synthetic oligonucleotide
  Target: FXN; (+) strand; PAM type: YTN; PAM sequence: TTA
aacagaaataaggttatata

SEQ ID NO: 31840 - DNA, 20 bp, Artificial Sequence
  Description of Artificial Sequence: Synthetic oligonucleotide
  Target: FXN; (+) strand; PAM type: YTN; PAM sequence: TTA
tatattgatcgattggtaac

SEQ ID NO: 31841 - DNA, 20 bp, Artificial Sequence
  Description of Artificial Sequence: Synthetic oligonucleotide
  Target: FXN; (+) strand; PAM type: YTN; PAM sequence: TTG
atcgattggtaacaatgttg

SEQ ID NO: 31842 - DNA, 20 bp, Artificial Sequence
  Description of Artificial Sequence: Synthetic oligonucleotide
  Target: FXN; (+) strand; PAM type: YTN; PAM sequence: TTG
gtaacaatgttgtgaccagc

SEQ ID NO: 31843 - DNA, 20 bp, Artificial Sequence
  Description of Artificial Sequence: Synthetic oligonucleotide
  Target: FXN; (+) strand; PAM type: YTN; PAM sequence: TTG
tgaccagcagcttacagggt

SEQ ID NO: 31844 - DNA, 20 bp, Artificial Sequence
  Description of Artificial Sequence: Synthetic oligonucleotide
  Target: FXN; (+) strand; PAM type: YTN; PAM sequence: CTT
acagggtacctagccttgta

SEQ ID NO: 31845 - DNA, 20 bp, Artificial Sequence
  Description of Artificial Sequence: Synthetic oligonucleotide
  Target: FXN; (+) strand; PAM type: YTN; PAM sequence: TTA
cagggtacctagccttgtat

SEQ ID NO: 31846 - DNA, 20 bp, Artificial Sequence
  Description of Artificial Sequence: Synthetic oligonucleotide
  Target: FXN; (+) strand; PAM type: YTN; PAM sequence: CTA
gccttgtatttctcctataa

SEQ ID NO: 31847 - DNA, 20 bp, Artificial Sequence
  Description of Artificial Sequence: Synthetic oligonucleotide
  Target: FXN; (+) strand; PAM type: YTN; PAM sequence: CTT
gtatttctcctataaataat

SEQ ID NO: 31848 - DNA, 20 bp, Artificial Sequence
  Description of Artificial Sequence: Synthetic oligonucleotide
  Target: FXN; (+) strand; PAM type: YTN; PAM sequence: TTG
tatttctcctataaataatt

SEQ ID NO: 31849 - DNA, 20 bp, Artificial Sequence
  Description of Artificial Sequence: Synthetic oligonucleotide
  Target: FXN; (+) strand; PAM type: YTN; PAM sequence: TTT
ctcctataaataatttgctc

SEQ ID NO: 31850 - DNA, 20 bp, Artificial Sequence
  Description of Artificial Sequence: Synthetic oligonucleotide
  Target: FXN; (+) strand; PAM type: YTN; PAM sequence: TTC
tcctataaataatttgctcg

SEQ ID NO: 31851 - DNA, 20 bp, Artificial Sequence
  Description of Artificial Sequence: Synthetic oligonucleotide
  Target: FXN; (+) strand; PAM type: YTN; PAM sequence: CTC
ctataaataatttgctcgtt

SEQ ID NO: 31852 - DNA, 20 bp, Artificial Sequence
  Description of Artificial Sequence: Synthetic oligonucleotide
  Target: FXN; (+) strand; PAM type: YTN; PAM sequence: CTA
taaataatttgctcgttgag

SEQ ID NO: 31853 - DNA, 20 bp, Artificial Sequence
  Description of Artificial Sequence: Synthetic oligonucleotide
  Target: FXN; (+) strand; PAM type: YTN; PAM sequence: TTT
gctcgttgagtgtttgtggc

SEQ ID NO: 31854 - DNA, 20 bp, Artificial Sequence
  Description of Artificial Sequence: Synthetic oligonucleotide
  Target: FXN; (+) strand; PAM type: YTN; PAM sequence: TTG
ctcgttgagtgtttgtggca

SEQ ID NO: 31855 - DNA, 20 bp, Artificial Sequence
  Description of Artificial Sequence: Synthetic oligonucleotide
  Target: FXN; (+) strand; PAM type: YTN; PAM sequence: CTC
gttgagtgtttgtggcaact

SEQ ID NO: 31856 - DNA, 20 bp, Artificial Sequence
  Description of Artificial Sequence: Synthetic oligonucleotide
  Target: FXN; (+) strand; PAM type: YTN; PAM sequence: TTG
agtgtttgtggcaactttgt

SEQ ID NO: 31857 - DNA, 20 bp, Artificial Sequence
  Description of Artificial Sequence: Synthetic oligonucleotide
  Target: FXN; (+) strand; PAM type: YTN; PAM sequence: TTT
gtggcaactttgtagcacat

SEQ ID NO: 31858 - DNA, 20 bp, Artificial Sequence
  Description of Artificial Sequence: Synthetic oligonucleotide
  Target: FXN; (+) strand; PAM type: YTN; PAM sequence: TTG
tggcaactttgtagcacata

SEQ ID NO: 31859 - DNA, 20 bp, Artificial Sequence
  Description of Artificial Sequence: Synthetic oligonucleotide
  Target: FXN; (+) strand; PAM type: YTN; PAM sequence: CTT
tgtagcacataactaccaag

SEQ ID NO: 31860 - DNA, 20 bp, Artificial Sequence
  Description of Artificial Sequence: Synthetic oligonucleotide
  Target: FXN; (+) strand; PAM type: YTN; PAM sequence: TTT
gtagcacataactaccaaga

SEQ ID NO: 31861 - DNA, 20 bp, Artificial Sequence
  Description of Artificial Sequence: Synthetic oligonucleotide
  Target: FXN; (+) strand; PAM type: YTN; PAM sequence: TTG
tagcacataactaccaagaa

SEQ ID NO: 31862 - DNA, 20 bp, Artificial Sequence
  Description of Artificial Sequence: Synthetic oligonucleotide
  Target: FXN; (+) strand; PAM type: YTN; PAM sequence: CTA
ccaagaataaggactgtaat

SEQ ID NO: 31863 - DNA, 20 bp, Artificial Sequence
  Description of Artificial Sequence: Synthetic oligonucleotide
  Target: FXN; (+) strand; PAM type: YTN; PAM sequence: CTG
taataagagtacgtccctca

SEQ ID NO: 31864 - DNA, 20 bp, Artificial Sequence
  Description of Artificial Sequence: Synthetic oligonucleotide
  Target: FXN; (+) strand; PAM type: YTN; PAM sequence: CTC
acaggattgtaatgaagact

SEQ ID NO: 31865 - DNA, 20 bp, Artificial Sequence
  Description of Artificial Sequence: Synthetic oligonucleotide
  Target: FXN; (+) strand; PAM type: YTN; PAM sequence: TTG
taatgaagactgagtccatt

SEQ ID NO: 31866 - DNA, 20 bp, Artificial Sequence
  Description of Artificial Sequence: Synthetic oligonucleotide
  Target: FXN; (+) strand; PAM type: YTN; PAM sequence: CTG
agtccatttacataaaggct

SEQ ID NO: 31867 - DNA, 20 bp, Artificial Sequence
  Description of Artificial Sequence: Synthetic oligonucleotide
  Target: FXN; (+) strand; PAM type: YTN; PAM sequence: TTT
acataaaggctgagagcagt

SEQ ID NO: 31868 - DNA, 20 bp, Artificial Sequence
  Description of Artificial Sequence: Synthetic oligonucleotide
  Target: FXN; (+) strand; PAM type: YTN; PAM sequence: TTA
cataaaggctgagagcagtg

SEQ ID NO: 31869 - DNA, 20 bp, Artificial Sequence
  Description of Artificial Sequence: Synthetic oligonucleotide
  Target: FXN; (+) strand; PAM type: YTN; PAM sequence: CTG
agagcagtgtcaagcagatg

SEQ ID NO: 31870 - DNA, 20 bp, Artificial Sequence
  Description of Artificial Sequence: Synthetic oligonucleotide
  Target: FXN; (+) strand; PAM type: YTN; PAM sequence: CTG
tagaatgtgcgatagctcta

SEQ ID NO: 31871 - DNA, 20 bp, Artificial Sequence
  Description of Artificial Sequence: Synthetic oligonucleotide
  Target: FXN; (+) strand; PAM type: YTN; PAM sequence: CTC
taacagtggttatcatggct

SEQ ID NO: 31872 - DNA, 20 bp, Artificial Sequence
  Description of Artificial Sequence: Synthetic oligonucleotide
  Target: FXN; (+) strand; PAM type: YTN; PAM sequence: CTA
acagtggttatcatggctgc

SEQ ID NO: 31873 - DNA, 20 bp, Artificial Sequence
  Description of Artificial Sequence: Synthetic oligonucleotide
  Target: FXN; (+) strand; PAM type: YTN; PAM sequence: TTA
tcatggctgccctctcactt

SEQ ID NO: 31874 - DNA, 20 bp, Artificial Sequence
  Description of Artificial Sequence: Synthetic oligonucleotide
  Target: FXN; (+) strand; PAM type: YTN; PAM sequence: CTG
ccctctcacttcttcagaga

SEQ ID NO: 31875 - DNA, 20 bp, Artificial Sequence
  Description of Artificial Sequence: Synthetic oligonucleotide
  Target: FXN; (+) strand; PAM type: YTN; PAM sequence: CTC
tcacttcttcagagacatgt

SEQ ID NO: 31876 - DNA, 20 bp, Artificial Sequence
  Description of Artificial Sequence: Synthetic oligonucleotide
  Target: FXN; (+) strand; PAM type: YTN; PAM sequence: CTC
acttcttcagagacatgtgt

SEQ ID NO: 31877 - DNA, 20 bp, Artificial Sequence
  Description of Artificial Sequence: Synthetic oligonucleotide
  Target: FXN; (+) strand; PAM type: YTN; PAM sequence: CTT
cttcagagacatgtgtttct

SEQ ID NO: 31878 - DNA, 20 bp, Artificial Sequence
  Description of Artificial Sequence: Synthetic oligonucleotide
  Target: FXN; (+) strand; PAM type: YTN; PAM sequence: TTC
ttcagagacatgtgtttcta

SEQ ID NO: 31879 - DNA, 20 bp, Artificial Sequence
  Description of Artificial Sequence: Synthetic oligonucleotide
  Target: FXN; (+) strand; PAM type: YTN; PAM sequence: CTT
cagagacatgtgtttctaag

SEQ ID NO: 31880 - DNA, 20 bp, Artificial Sequence
  Description of Artificial Sequence: Synthetic oligonucleotide
  Target: FXN; (+) strand; PAM type: YTN; PAM sequence: TTC
agagacatgtgtttctaagg

SEQ ID NO: 31881 - DNA, 20 bp, Artificial Sequence
  Description of Artificial Sequence: Synthetic oligonucleotide
  Target: FXN; (+) strand; PAM type: YTN; PAM sequence: TTT
ctaaggtctgcactctgccc

SEQ ID NO: 31882 - DNA, 20 bp, Artificial Sequence
  Description of Artificial Sequence: Synthetic oligonucleotide
  Target: FXN; (+) strand; PAM type: YTN; PAM sequence: TTC
taaggtctgcactctgcccc

SEQ ID NO: 31883 - DNA, 20 bp, Artificial Sequence
  Description of Artificial Sequence: Synthetic oligonucleotide
  Target: FXN; (+) strand; PAM type: YTN; PAM sequence: CTA
aggtctgcactctgccccac

SEQ ID NO: 31884 - DNA, 20 bp, Artificial Sequence
  Description of Artificial Sequence: Synthetic oligonucleotide
  Target: FXN; (+) strand; PAM type: YTN; PAM sequence: CTG
cactctgccccaccctcccc

SEQ ID NO: 31885 - DNA, 20 bp, Artificial Sequence
  Description of Artificial Sequence: Synthetic oligonucleotide
  Target: FXN; (+) strand; PAM type: YTN; PAM sequence: CTC
tgccccaccctccccatcca

SEQ ID NO: 31886 - DNA, 20 bp, Artificial Sequence
  Description of Artificial Sequence: Synthetic oligonucleotide
  Target: FXN; (+) strand; PAM type: YTN; PAM sequence: CTG
ccccaccctccccatccact

SEQ ID NO: 31887 - DNA, 20 bp, Artificial Sequence
  Description of Artificial Sequence: Synthetic oligonucleotide
  Target: FXN; (+) strand; PAM type: YTN; PAM sequence: CTC
cccatccactgtcccccagc

SEQ ID NO: 31888 - DNA, 20 bp, Artificial Sequence
  Description of Artificial Sequence: Synthetic oligonucleotide
  Target: FXN; (+) strand; PAM type: YTN; PAM sequence: CTG
tcccccagcccgtttcctcc

SEQ ID NO: 31889 - DNA, 20 bp, Artificial Sequence
  Description of Artificial Sequence: Synthetic oligonucleotide
  Target: FXN; (+) strand; PAM type: YTN; PAM sequence: TTT
cctcctccacttacttccca

SEQ ID NO: 31890 - DNA, 20 bp, Artificial Sequence
  Description of Artificial Sequence: Synthetic oligonucleotide
  Target: FXN; (+) strand; PAM type: YTN; PAM sequence: TTC
ctcctccacttacttcccag

SEQ ID NO: 31891 - DNA, 20 bp, Artificial Sequence
  Description of Artificial Sequence: Synthetic oligonucleotide
  Target: FXN; (+) strand; PAM type: YTN; PAM sequence: CTC
ctccacttacttcccagccc

SEQ ID NO: 31892 - DNA, 20 bp, Artificial Sequence
  Description of Artificial Sequence: Synthetic oligonucleotide
  Target: FXN; (+) strand; PAM type: YTN; PAM sequence: CTC
cacttacttcccagccctgt

SEQ ID NO: 31893 - DNA, 20 bp, Artificial Sequence
  Description of Artificial Sequence: Synthetic oligonucleotide
  Target: FXN; (+) strand; PAM type: YTN; PAM sequence: CTT
acttcccagccctgtgcctt

SEQ ID NO: 31894 - DNA, 20 bp, Artificial Sequence
  Description of Artificial Sequence: Synthetic oligonucleotide
  Target: FXN; (+) strand; PAM type: YTN; PAM sequence: TTA
cttcccagccctgtgccttc

SEQ ID NO: 31895 - DNA, 20 bp, Artificial Sequence
  Description of Artificial Sequence: Synthetic oligonucleotide
  Target: FXN; (+) strand; PAM type: YTN; PAM sequence: CTT
cccagccctgtgccttctgc

SEQ ID NO: 31896 - DNA, 20 bp, Artificial Sequence
  Description of Artificial Sequence: Synthetic oligonucleotide
  Target: FXN; (+) strand; PAM type: YTN; PAM sequence: TTC
ccagccctgtgccttctgcc

SEQ ID NO: 31897 - DNA, 20 bp, Artificial Sequence
  Description of Artificial Sequence: Synthetic oligonucleotide
  Target: FXN; (+) strand; PAM type: YTN; PAM sequence: CTG
tgccttctgccttctctttt

SEQ ID NO: 31898 - DNA, 20 bp, Artificial Sequence
  Description of Artificial Sequence: Synthetic oligonucleotide
  Target: FXN; (+) strand; PAM type: YTN; PAM sequence: CTT
ctgccttctcttttctgagt

SEQ ID NO: 31899 - DNA, 20 bp, Artificial Sequence
  Description of Artificial Sequence: Synthetic oligonucleotide
  Target: FXN; (+) strand; PAM type: YTN; PAM sequence: TTC
tgccttctcttttctgagtt

SEQ ID NO: 31900 - DNA, 20 bp, Artificial Sequence
  Description of Artificial Sequence: Synthetic oligonucleotide
  Target: FXN; (+) strand; PAM type: YTN; PAM sequence: CTG
ccttctcttttctgagtttg

SEQ ID NO: 31901 - DNA, 20 bp, Artificial Sequence
  Description of Artificial Sequence: Synthetic oligonucleotide
  Target: FXN; (+) strand; PAM type: YTN; PAM sequence: CTT
ctcttttctgagtttgctaa

SEQ ID NO: 31902 - DNA, 20 bp, Artificial Sequence
  Description of Artificial Sequence: Synthetic oligonucleotide
  Target: FXN; (+) strand; PAM type: YTN; PAM sequence: TTC
tcttttctgagtttgctaag

SEQ ID NO: 31903 - DNA, 20 bp, Artificial Sequence
  Description of Artificial Sequence: Synthetic oligonucleotide
  Target: FXN; (+) strand; PAM type: YTN; PAM sequence: CTC
ttttctgagtttgctaaggg

SEQ ID NO: 31904 - DNA, 20 bp, Artificial Sequence
  Description of Artificial Sequence: Synthetic oligonucleotide
  Target: FXN; (+) strand; PAM type: YTN; PAM sequence: CTT
ttctgagtttgctaagggca

SEQ ID NO: 31905 - DNA, 20 bp, Artificial Sequence
  Description of Artificial Sequence: Synthetic oligonucleotide
  Target: FXN; (+) strand; PAM type: YTN; PAM sequence: TTT
tctgagtttgctaagggcac

SEQ ID NO: 31906 - DNA, 20 bp, Artificial Sequence
  Description of Artificial Sequence: Synthetic oligonucleotide
  Target: FXN; (+) strand; PAM type: YTN; PAM sequence: TTT
ctgagtttgctaagggcact

SEQ ID NO: 31907 - DNA, 20 bp, Artificial Sequence
  Description of Artificial Sequence: Synthetic oligonucleotide
  Target: FXN; (+) strand; PAM type: YTN; PAM sequence: TTC
tgagtttgctaagggcactg

SEQ ID NO: 31908 - DNA, 20 bp, Artificial Sequence
  Description of Artificial Sequence: Synthetic oligonucleotide
  Target: FXN; (+) strand; PAM type: YTN; PAM sequence: CTG
agtttgctaagggcactgct

SEQ ID NO: 31909 - DNA, 20 bp, Artificial Sequence
  Description of Artificial Sequence: Synthetic oligonucleotide
  Target: FXN; (+) strand; PAM type: YTN; PAM sequence: TTT
gctaagggcactgctggctc

SEQ ID NO: 31910 - DNA, 20 bp, Artificial Sequence
  Description of Artificial Sequence: Synthetic oligonucleotide
  Target: FXN; (+) strand; PAM type: YTN; PAM sequence: TTG
ctaagggcactgctggctca

SEQ ID NO: 31911 - DNA, 20 bp, Artificial Sequence
  Description of Artificial Sequence: Synthetic oligonucleotide
  Target: FXN; (+) strand; PAM type: YTN; PAM sequence: CTA
agggcactgctggctcaaga

SEQ ID NO: 31912 - DNA, 20 bp, Artificial Sequence
  Description of Artificial Sequence: Synthetic oligonucleotide
  Target: FXN; (+) strand; PAM type: YTN; PAM sequence: CTG
ctggctcaagagcagtaact

SEQ ID NO: 31913 - DNA, 20 bp, Artificial Sequence
  Description of Artificial Sequence: Synthetic oligonucleotide
  Target: FXN; (+) strand; PAM type: YTN; PAM sequence: CTG
gctcaagagcagtaactaac

SEQ ID NO: 31914 - DNA, 20 bp, Artificial Sequence
  Description of Artificial Sequence: Synthetic oligonucleotide
  Target: FXN; (+) strand; PAM type: YTN; PAM sequence: CTC
aagagcagtaactaacagtc

SEQ ID NO: 31915 - DNA, 20 bp, Artificial Sequence
  Description of Artificial Sequence: Synthetic oligonucleotide
  Target: FXN; (+) strand; PAM type: YTN; PAM sequence: CTA
acagtctctcgcctcttctc

SEQ ID NO: 31916 - DNA, 20 bp, Artificial Sequence
  Description of Artificial Sequence: Synthetic oligonucleotide
  Target: FXN; (+) strand; PAM type: YTN; PAM sequence: CTC
tcgcctcttctctccatggc

SEQ ID NO: 31917 - DNA, 20 bp, Artificial Sequence
  Description of Artificial Sequence: Synthetic oligonucleotide
  Target: FXN; (+) strand; PAM type: YTN; PAM sequence: CTC
gcctcttctctccatggcaa

SEQ ID NO: 31918 - DNA, 20 bp, Artificial Sequence
  Description of Artificial Sequence: Synthetic oligonucleotide
  Target: FXN; (+) strand; PAM type: YTN; PAM sequence: CTC
ttctctccatggcaaccagt

SEQ ID NO: 31919 - DNA, 20 bp, Artificial Sequence
  Description of Artificial Sequence: Synthetic oligonucleotide
  Target: FXN; (+) strand; PAM type: YTN; PAM sequence: CTT
ctctccatggcaaccagtga

SEQ ID NO: 31920 - DNA, 20 bp, Artificial Sequence
  Description of Artificial Sequence: Synthetic oligonucleotide
  Target: FXN; (+) strand; PAM type: YTN; PAM sequence: TTC
tctccatggcaaccagtgac

SEQ ID NO: 31921 - DNA, 20 bp, Artificial Sequence
  Description of Artificial Sequence: Synthetic oligonucleotide
  Target: FXN; (+) strand; PAM type: YTN; PAM sequence: CTC
tccatggcaaccagtgacct

SEQ ID NO: 31922 - DNA, 20 bp, Artificial Sequence
  Description of Artificial Sequence: Synthetic oligonucleotide
  Target: FXN; (+) strand; PAM type: YTN; PAM sequence: CTC
catggcaaccagtgaccttt

SEQ ID NO: 31923 - DNA, 20 bp, Artificial Sequence
  Description of Artificial Sequence: Synthetic oligonucleotide
  Target: FXN; (+) strand; PAM type: YTN; PAM sequence: CTT
tggagaatgtaaaccttatc

SEQ ID NO: 31924 - DNA, 20 bp, Artificial Sequence
  Description of Artificial Sequence: Synthetic oligonucleotide
  Target: FXN; (+) strand; PAM type: YTN; PAM sequence: TTT
ggagaatgtaaaccttatca

SEQ ID NO: 31925 - DNA, 20 bp, Artificial Sequence
  Description of Artificial Sequence: Synthetic oligonucleotide
  Target: FXN; (+) strand; PAM type: YTN; PAM sequence: TTG
gagaatgtaaaccttatcac

SEQ ID NO: 31926 - DNA, 20 bp, Artificial Sequence
  Description of Artificial Sequence: Synthetic oligonucleotide
  Target: FXN; (+) strand; PAM type: YTN; PAM sequence: CTT
atcaccaatctcttaaagcc

SEQ ID NO: 31927 - DNA, 20 bp, Artificial Sequence
  Description of Artificial Sequence: Synthetic oligonucleotide
  Target: FXN; (+) strand; PAM type: YTN; PAM sequence: TTA
tcaccaatctcttaaagccc

SEQ ID NO: 31928 - DNA, 20 bp, Artificial Sequence
  Description of Artificial Sequence: Synthetic oligonucleotide
  Target: FXN; (+) strand; PAM type: YTN; PAM sequence: CTC
ttaaagcccttcggtgcctt

SEQ ID NO: 31929 - DNA, 20 bp, Artificial Sequence
  Description of Artificial Sequence: Synthetic oligonucleotide
  Target: FXN; (+) strand; PAM type: YTN; PAM sequence: CTT
aaagcccttcggtgccttcc

SEQ ID NO: 31930 - DNA, 20 bp, Artificial Sequence
  Description of Artificial Sequence: Synthetic oligonucleotide
  Target: FXN; (+) strand; PAM type: YTN; PAM sequence: TTA
aagcccttcggtgccttccc

SEQ ID NO: 31931 - DNA, 20 bp, Artificial Sequence
  Description of Artificial Sequence: Synthetic oligonucleotide
  Target: FXN; (+) strand; PAM type: YTN; PAM sequence: CTT
cggtgccttcccaggatgac

SEQ ID NO: 31932 - DNA, 20 bp, Artificial Sequence
  Description of Artificial Sequence: Synthetic oligonucleotide
  Target: FXN; (+) strand; PAM type: YTN; PAM sequence: TTC
ggtgccttcccaggatgacg

SEQ ID NO: 31933 - DNA, 20 bp, Artificial Sequence
  Description of Artificial Sequence: Synthetic oligonucleotide
  Target: FXN; (+) strand; PAM type: YTN; PAM sequence: CTT
cccaggatgacgtccagctg

SEQ ID NO: 31934 - DNA, 20 bp, Artificial Sequence
  Description of Artificial Sequence: Synthetic oligonucleotide
  Target: FXN; (+) strand; PAM type: YTN; PAM sequence: TTC
ccaggatgacgtccagctga

SEQ ID NO: 31935 - DNA, 20 bp, Artificial Sequence
  Description of Artificial Sequence: Synthetic oligonucleotide
  Target: FXN; (+) strand; PAM type: YTN; PAM sequence: CTG
aggtccttggcaagacccag

SEQ ID NO: 31936 - DNA, 20 bp, Artificial Sequence
  Description of Artificial Sequence: Synthetic oligonucleotide
  Target: FXN; (+) strand; PAM type: YTN; PAM sequence: CTT
ggcaagacccagggcgcccc

SEQ ID NO: 31937 - DNA, 20 bp, Artificial Sequence
  Description of Artificial Sequence: Synthetic oligonucleotide
  Target: FXN; (+) strand; PAM type: YTN; PAM sequence: TTG
gcaagacccagggcgccccc

SEQ ID NO: 31938 - DNA, 20 bp, Artificial Sequence
  Description of Artificial Sequence: Synthetic oligonucleotide
  Target: FXN; (+) strand; PAM type: YTN; PAM sequence: CTC
ctcgctccatcacctcccct

SEQ ID NO: 31939 - DNA, 20 bp, Artificial Sequence
  Description of Artificial Sequence: Synthetic oligonucleotide
  Target: FXN; (+) strand; PAM type: YTN; PAM sequence: CTC
gctccatcacctcccctgtc

SEQ ID NO: 31940 - DNA, 20 bp, Artificial Sequence
  Description of Artificial Sequence: Synthetic oligonucleotide
  Target: FXN; (+) strand; PAM type: YTN; PAM sequence: CTC
catcacctcccctgtcacct

SEQ ID NO: 31941 - DNA, 20 bp, Artificial Sequence
  Description of Artificial Sequence: Synthetic oligonucleotide
  Target: FXN; (+) strand; PAM type: YTN; PAM sequence: CTC
ccctgtcacctcccctgcat

SEQ ID NO: 31942 - DNA, 20 bp, Artificial Sequence
  Description of Artificial Sequence: Synthetic oligonucleotide
  Target: FXN; (+) strand; PAM type: YTN; PAM sequence: CTG
tcacctcccctgcatctccc

SEQ ID NO: 31943 - DNA, 20 bp, Artificial Sequence
  Description of Artificial Sequence: Synthetic oligonucleotide
  Target: FXN; (+) strand; PAM type: YTN; PAM sequence: CTC
ccctgcatctccctactcca

SEQ ID NO: 31944 - DNA, 20 bp, Artificial Sequence
  Description of Artificial Sequence: Synthetic oligonucleotide
  Target: FXN; (+) strand; PAM type: YTN; PAM sequence: CTG
catctccctactccagctgc

SEQ ID NO: 31945 - DNA, 20 bp, Artificial Sequence
  Description of Artificial Sequence: Synthetic oligonucleotide
  Target: FXN; (+) strand; PAM type: YTN; PAM sequence: CTC
cctactccagctgcaccact

SEQ ID NO: 31946 - DNA, 20 bp, Artificial Sequence
  Description of Artificial Sequence: Synthetic oligonucleotide
  Target: FXN; (+) strand; PAM type: YTN; PAM sequence: CTA
ctccagctgcaccactcttg

SEQ ID NO: 31947 - DNA, 20 bp, Artificial Sequence
  Description of Artificial Sequence: Synthetic oligonucleotide
  Target: FXN; (+) strand; PAM type: YTN; PAM sequence: CTC
cagctgcaccactcttgtgc

SEQ ID NO: 31948 - DNA, 20 bp, Artificial Sequence
  Description of Artificial Sequence: Synthetic oligonucleotide
  Target: FXN; (+) strand; PAM type: YTN; PAM sequence: CTG
caccactcttgtgccccagt

SEQ ID NO: 31949 - DNA, 20 bp, Artificial Sequence
  Description of Artificial Sequence: Synthetic oligonucleotide
  Target: FXN; (+) strand; PAM type: YTN; PAM sequence: CTC
ttgtgccccagtggctcttg

SEQ ID NO: 31950 - DNA, 20 bp, Artificial Sequence
  Description of Artificial Sequence: Synthetic oligonucleotide
  Target: FXN; (+) strand; PAM type: YTN; PAM sequence: CTT
gtgccccagtggctcttgtc

SEQ ID NO: 31951 - DNA, 20 bp, Artificial Sequence
  Description of Artificial Sequence: Synthetic oligonucleotide
  Target: FXN; (+) strand; PAM type: YTN; PAM sequence: TTG
tgccccagtggctcttgtct

SEQ ID NO: 31952 - DNA, 20 bp, Artificial Sequence
  Description of Artificial Sequence: Synthetic oligonucleotide
  Target: FXN; (+) strand; PAM type: YTN; PAM sequence: CTC
ttgtctgattatttccttca

SEQ ID NO: 31953 - DNA, 20 bp, Artificial Sequence
  Description of Artificial Sequence: Synthetic oligonucleotide
  Target: FXN; (+) strand; PAM type: YTN; PAM sequence: CTT
gtctgattatttccttcatc

SEQ ID NO: 31954 - DNA, 20 bp, Artificial Sequence
  Description of Artificial Sequence: Synthetic oligonucleotide
  Target: FXN; (+) strand; PAM type: YTN; PAM sequence: TTG
tctgattatttccttcatct

SEQ ID NO: 31955 - DNA, 20 bp, Artificial Sequence
  Description of Artificial Sequence: Synthetic oligonucleotide
  Target: FXN; (+) strand; PAM type: YTN; PAM sequence: CTG
attatttccttcatctcccc

SEQ ID NO: 31956 - DNA, 20 bp, Artificial Sequence
  Description of Artificial Sequence: Synthetic oligonucleotide
  Target: FXN; (+) strand; PAM type: YTN; PAM sequence: TTA
tttccttcatctccccagct

SEQ ID NO: 31957 - DNA, 20 bp, Artificial Sequence
  Description of Artificial Sequence: Synthetic oligonucleotide
  Target: FXN; (+) strand; PAM type: YTN; PAM sequence: TTT
ccttcatctccccagctggt

SEQ ID NO: 31958 - DNA, 20 bp, Artificial Sequence
  Description of Artificial Sequence: Synthetic oligonucleotide
  Target: FXN; (+) strand; PAM type: YTN; PAM sequence: TTC
cttcatctccccagctggtc

SEQ ID NO: 31959 - DNA, 20 bp, Artificial Sequence
  Description of Artificial Sequence: Synthetic oligonucleotide
  Target: FXN; (+) strand; PAM type: YTN; PAM sequence: CTT
catctccccagctggtcagc

SEQ ID NO: 31960 - DNA, 20 bp, Artificial Sequence
  Description of Artificial Sequence: Synthetic oligonucleotide
  Target: FXN; (+) strand; PAM type: YTN; PAM sequence: TTC
atctccccagctggtcagca

SEQ ID NO: 31961 - DNA, 20 bp, Artificial Sequence
  Description of Artificial Sequence: Synthetic oligonucleotide
  Target: FXN; (+) strand; PAM type: YTN; PAM sequence: CTC
cccagctggtcagcagagct

SEQ ID NO: 31962 - DNA, 20 bp, Artificial Sequence
  Description of Artificial Sequence: Synthetic oligonucleotide
  Target: FXN; (+) strand; PAM type: YTN; PAM sequence: CTG
gtcagcagagctggtggtaa

SEQ ID NO: 31963 - DNA, 20 bp, Artificial Sequence
  Description of Artificial Sequence: Synthetic oligonucleotide
  Target: FXN; (+) strand; PAM type: YTN; PAM sequence: CTG
gtggtaatcaactcagaccc

SEQ ID NO: 31964 - DNA, 20 bp, Artificial Sequence
  Description of Artificial Sequence: Synthetic oligonucleotide
  Target: FXN; (+) strand; PAM type: YTN; PAM sequence: CTC
agaccctgtcacctggatgt

SEQ ID NO: 31965 - DNA, 20 bp, Artificial Sequence
  Description of Artificial Sequence: Synthetic oligonucleotide
  Target: FXN; (+) strand; PAM type: YTN; PAM sequence: CTG
tcacctggatgtccagcagt

SEQ ID NO: 31966 - DNA, 20 bp, Artificial Sequence
  Description of Artificial Sequence: Synthetic oligonucleotide
  Target: FXN; (+) strand; PAM type: YTN; PAM sequence: CTG
gatgtccagcagttagggac

SEQ ID NO: 31967 - DNA, 20 bp, Artificial Sequence
  Description of Artificial Sequence: Synthetic oligonucleotide
  Target: FXN; (+) strand; PAM type: YTN; PAM sequence: TTA
gggactaaaaaaaatcaaca

SEQ ID NO: 31968 - DNA, 20 bp, Artificial Sequence
  Description of Artificial Sequence: Synthetic oligonucleotide
  Target: FXN; (+) strand; PAM type: YTN; PAM sequence: CTA
aaaaaaatcaacaggtcaca

SEQ ID NO: 31969 - DNA, 20 bp, Artificial Sequence
  Description of Artificial Sequence: Synthetic oligonucleotide
  Target: FXN; (+) strand; PAM type: YTN; PAM sequence: TTC
tgtcctgcagatcatgataa

SEQ ID NO: 31970 - DNA, 20 bp, Artificial Sequence
  Description of Artificial Sequence: Synthetic oligonucleotide
  Target: FXN; (+) strand; PAM type: YTN; PAM sequence: CTG
tcctgcagatcatgataata

SEQ ID NO: 31971 - DNA, 20 bp, Artificial Sequence
  Description of Artificial Sequence: Synthetic oligonucleotide
  Target: FXN; (+) strand; PAM type: YTN; PAM sequence: CTG
cagatcatgataataagatc

SEQ ID NO: 31972 - DNA, 20 bp, Artificial Sequence
  Description of Artificial Sequence: Synthetic oligonucleotide
  Target: FXN; (+) strand; PAM type: YTN; PAM sequence: CTG
tcagacagcagtcagcagtc

SEQ ID NO: 31973 - DNA, 20 bp, Artificial Sequence
  Description of Artificial Sequence: Synthetic oligonucleotide
  Target: FXN; (+) strand; PAM type: YTN; PAM sequence: CTT
ctggacttcagcaggattct

SEQ ID NO: 31974 - DNA, 20 bp, Artificial Sequence
  Description of Artificial Sequence: Synthetic oligonucleotide
  Target: FXN; (+) strand; PAM type: YTN; PAM sequence: TTC
tggacttcagcaggattctg

SEQ ID NO: 31975 - DNA, 20 bp, Artificial Sequence
  Description of Artificial Sequence: Synthetic oligonucleotide
  Target: FXN; (+) strand; PAM type: YTN; PAM sequence: CTG
gacttcagcaggattctgcc

SEQ ID NO: 31976 - DNA, 20 bp, Artificial Sequence
  Description of Artificial Sequence: Synthetic oligonucleotide
  Target: FXN; (+) strand; PAM type: YTN; PAM sequence: CTT
cagcaggattctgcctcttg

SEQ ID NO: 31977 - DNA, 20 bp, Artificial Sequence
  Description of Artificial Sequence: Synthetic oligonucleotide
  Target: FXN; (+) strand; PAM type: YTN; PAM sequence: TTC
agcaggattctgcctcttgc

SEQ ID NO: 31978 - DNA, 20 bp, Artificial Sequence
  Description of Artificial Sequence: Synthetic oligonucleotide
  Target: FXN; (+) strand; PAM type: YTN; PAM sequence: TTC
tgcctcttgctatttcctgt

SEQ ID NO: 31979 - DNA, 20 bp, Artificial Sequence
  Description of Artificial Sequence: Synthetic oligonucleotide
  Target: FXN; (+) strand; PAM type: YTN; PAM sequence: CTG
cctcttgctatttcctgttg

SEQ ID NO: 31980 - DNA, 20 bp, Artificial Sequence
  Description of Artificial Sequence: Synthetic oligonucleotide
  Target: FXN; (+) strand; PAM type: YTN; PAM sequence: CTC
ttgctatttcctgttgcctc

SEQ ID NO: 31981 - DNA, 20 bp, Artificial Sequence
  Description of Artificial Sequence: Synthetic oligonucleotide
  Target: FXN; (+) strand; PAM type: YTN; PAM sequence: CTT
gctatttcctgttgcctctc

SEQ ID NO: 31982 - DNA, 20 bp, Artificial Sequence
  Description of Artificial Sequence: Synthetic oligonucleotide
  Target: FXN; (+) strand; PAM type: YTN; PAM sequence: TTG
ctatttcctgttgcctctct

SEQ ID NO: 31983 - DNA, 20 bp, Artificial Sequence
  Description of Artificial Sequence: Synthetic oligonucleotide
  Target: FXN; (+) strand; PAM type: YTN; PAM sequence: CTA
tttcctgttgcctctcttag

SEQ ID NO: 31984 - DNA, 20 bp, Artificial Sequence
  Description of Artificial Sequence: Synthetic oligonucleotide
  Target: FXN; (+) strand; PAM type: YTN; PAM sequence: TTT
cctgttgcctctcttagtga

SEQ ID NO: 31985 - DNA, 20 bp, Artificial Sequence
  Description of Artificial Sequence: Synthetic oligonucleotide
  Target: FXN; (+) strand; PAM type: YTN; PAM sequence: TTC
ctgttgcctctcttagtgac

SEQ ID NO: 31986 - DNA, 20 bp, Artificial Sequence
  Description of Artificial Sequence: Synthetic oligonucleotide
  Target: FXN; (+) strand; PAM type: YTN; PAM sequence: CTG
ttgcctctcttagtgacctt

SEQ ID NO: 31987 - DNA, 20 bp, Artificial Sequence
  Description of Artificial Sequence: Synthetic oligonucleotide
  Target: FXN; (+) strand; PAM type: YTN; PAM sequence: TTG
cctctcttagtgacctttta

SEQ ID NO: 31988 - DNA, 20 bp, Artificial Sequence
  Description of Artificial Sequence: Synthetic oligonucleotide
  Target: FXN; (+) strand; PAM type: YTN; PAM sequence: CTC
tcttagtgaccttttaagag

SEQ ID NO: 31989 - DNA, 20 bp, Artificial Sequence
  Description of Artificial Sequence: Synthetic oligonucleotide
  Target: FXN; (+) strand; PAM type: YTN; PAM sequence: CTC
ttagtgaccttttaagagca

SEQ ID NO: 31990 - DNA, 20 bp, Artificial Sequence
  Description of Artificial Sequence: Synthetic oligonucleotide
  Target: FXN; (+) strand; PAM type: YTN; PAM sequence: CTT
agtgaccttttaagagcatt

SEQ ID NO: 31991 - DNA, 20 bp, Artificial Sequence
  Description of Artificial Sequence: Synthetic oligonucleotide
  Target: FXN; (+) strand; PAM type: YTN; PAM sequence: TTA
gtgaccttttaagagcattg

SEQ ID NO: 31992 - DNA, 20 bp, Artificial Sequence
  Description of Artificial Sequence: Synthetic oligonucleotide
  Target: FXN; (+) strand; PAM type: YTN; PAM sequence: CTT
ttaagagcattgtggatgcc

SEQ ID NO: 31993 - DNA, 20 bp, Artificial Sequence
  Description of Artificial Sequence: Synthetic oligonucleotide
  Target: FXN; (+) strand; PAM type: YTN; PAM sequence: TTT
taagagcattgtggatgcct

SEQ ID NO: 31994 - DNA, 20 bp, Artificial Sequence
  Description of Artificial Sequence: Synthetic oligonucleotide
  Target: FXN; (+) strand; PAM type: YTN; PAM sequence: TTT
aagagcattgtggatgcctc

SEQ ID NO: 31995 - DNA, 20 bp, Artificial Sequence
  Description of Artificial Sequence: Synthetic oligonucleotide
  Target: FXN; (+) strand; PAM type: YTN; PAM sequence: TTA
agagcattgtggatgcctcc

SEQ ID NO: 31996 - DNA, 20 bp, Artificial Sequence
  Description of Artificial Sequence: Synthetic oligonucleotide
  Target: FXN; (+) strand; PAM type: YTN; PAM sequence: TTG
tggatgcctcccagcctcct

SEQ ID NO: 31997 - DNA, 20 bp, Artificial Sequence
  Description of Artificial Sequence: Synthetic oligonucleotide
  Target: FXN; (+) strand; PAM type: YTN; PAM sequence: CTC
ccagcctcctgctaaccacc

SEQ ID NO: 31998 - DNA, 20 bp, Artificial Sequence
  Description of Artificial Sequence: Synthetic oligonucleotide
  Target: FXN; (+) strand; PAM type: YTN; PAM sequence: CTC
ctgctaaccaccctgtaacc

SEQ ID NO: 31999 - DNA, 20 bp, Artificial Sequence
  Description of Artificial Sequence: Synthetic oligonucleotide
  Target: FXN; (+) strand; PAM type: YTN; PAM sequence: CTG
ctaaccaccctgtaacctga

SEQ ID NO: 32000 - DNA, 20 bp, Artificial Sequence
  Description of Artificial Sequence: Synthetic oligonucleotide
  Target: FXN; (+) strand; PAM type: YTN; PAM sequence: CTA
accaccctgtaacctgaaca

SEQ ID NO: 32001 - DNA, 20 bp, Artificial Sequence
  Description of Artificial Sequence: Synthetic oligonucleotide
  Target: FXN; (+) strand; PAM type: YTN; PAM sequence: CTG
taacctgaacagcctgcagc

SEQ ID NO: 32002 - DNA, 20 bp, Artificial Sequence
  Description of Artificial Sequence: Synthetic oligonucleotide
  Target: FXN; (+) strand; PAM type: YTN; PAM sequence: CTG
aacagcctgcagcagccctg

SEQ ID NO: 32003 - DNA, 20 bp, Artificial Sequence
  Description of Artificial Sequence: Synthetic oligonucleotide
  Target: FXN; (+) strand; PAM type: YTN; PAM sequence: CTG
cagcagccctgcccagtaga

SEQ ID NO: 32004 - DNA, 20 bp, Artificial Sequence
  Description of Artificial Sequence: Synthetic oligonucleotide
  Target: FXN; (+) strand; PAM type: YTN; PAM sequence: CTG
cccagtagaacttcctgatg

SEQ ID NO: 32005 - DNA, 20 bp, Artificial Sequence
  Description of Artificial Sequence: Synthetic oligonucleotide
  Target: FXN; (+) strand; PAM type: YTN; PAM sequence: CTT
cctgatgtgatggaaatgct

SEQ ID NO: 32006 - DNA, 20 bp, Artificial Sequence
  Description of Artificial Sequence: Synthetic oligonucleotide
  Target: FXN; (+) strand; PAM type: YTN; PAM sequence: TTC
ctgatgtgatggaaatgctg

SEQ ID NO: 32007 - DNA, 20 bp, Artificial Sequence
  Description of Artificial Sequence: Synthetic oligonucleotide
  Target: FXN; (+) strand; PAM type: YTN; PAM sequence: CTG
atgtgatggaaatgctgtgt

SEQ ID NO: 32008 - DNA, 20 bp, Artificial Sequence
  Description of Artificial Sequence: Synthetic oligonucleotide
  Target: FXN; (+) strand; PAM type: YTN; PAM sequence: CTG
tgtctgcaccactagccaca

SEQ ID NO: 32009 - DNA, 20 bp, Artificial Sequence
  Description of Artificial Sequence: Synthetic oligonucleotide
  Target: FXN; (+) strand; PAM type: YTN; PAM sequence: CTG
caccactagccacatgtggc

SEQ ID NO: 32010 - DNA, 20 bp, Artificial Sequence
  Description of Artificial Sequence: Synthetic oligonucleotide
  Target: FXN; (+) strand; PAM type: YTN; PAM sequence: CTA
gccacatgtggccacaggat

SEQ ID NO: 32011 - DNA, 20 bp, Artificial Sequence
  Description of Artificial Sequence: Synthetic oligonucleotide
  Target: FXN; (+) strand; PAM type: YTN; PAM sequence: TTC
tcgaaactggtggtgcagtt

SEQ ID NO: 32012 - DNA, 20 bp, Artificial Sequence
  Description of Artificial Sequence: Synthetic oligonucleotide
  Target: FXN; (+) strand; PAM type: YTN; PAM sequence: CTC
gaaactggtggtgcagttga

SEQ ID NO: 32013 - DNA, 20 bp, Artificial Sequence
  Description of Artificial Sequence: Synthetic oligonucleotide
  Target: FXN; (+) strand; PAM type: YTN; PAM sequence: CTG
gtggtgcagttgaggagctg

SEQ ID NO: 32014 - DNA, 20 bp, Artificial Sequence
  Description of Artificial Sequence: Synthetic oligonucleotide
  Target: FXN; (+) strand; PAM type: YTN; PAM sequence: TTG
aggagctgactttatatttt

SEQ ID NO: 32015 - DNA, 20 bp, Artificial Sequence
  Description of Artificial Sequence: Synthetic oligonucleotide
  Target: FXN; (+) strand; PAM type: YTN; PAM sequence: CTG
actttatattttatctcatt

SEQ ID NO: 32016 - DNA, 20 bp, Artificial Sequence
  Description of Artificial Sequence: Synthetic oligonucleotide
  Target: FXN; (+) strand; PAM type: YTN; PAM sequence: CTT
tatattttatctcattaaat

SEQ ID NO: 32017 - DNA, 20 bp, Artificial Sequence
  Description of Artificial Sequence: Synthetic oligonucleotide
  Target: FXN; (+) strand; PAM type: YTN; PAM sequence: TTT
atattttatctcattaaatt

SEQ ID NO: 32018 - DNA, 20 bp, Artificial Sequence
  Description of Artificial Sequence: Synthetic oligonucleotide
  Target: FXN; (+) strand; PAM type: YTN; PAM sequence: TTA
tattttatctcattaaattt

SEQ ID NO: 32019 - DNA, 20 bp, Artificial Sequence
  Description of Artificial Sequence: Synthetic oligonucleotide
  Target: FXN; (+) strand; PAM type: YTN; PAM sequence: TTT
tatctcattaaatttaaatg

SEQ ID NO: 32020 - DNA, 20 bp, Artificial Sequence
  Description of Artificial Sequence: Synthetic oligonucleotide
  Target: FXN; (+) strand; PAM type: YTN; PAM sequence: TTT
atctcattaaatttaaatgt

SEQ ID NO: 32021 - DNA, 20 bp, Artificial Sequence
  Description of Artificial Sequence: Synthetic oligonucleotide
  Target: FXN; (+) strand; PAM type: YTN; PAM sequence: TTA
tctcattaaatttaaatgta

SEQ ID NO: 32022 - DNA, 20 bp, Artificial Sequence
  Description of Artificial Sequence: Synthetic oligonucleotide
  Target: FXN; (+) strand; PAM type: YTN; PAM sequence: CTC
attaaatttaaatgtaaata

SEQ ID NO: 32023 - DNA, 20 bp, Artificial Sequence
  Description of Artificial Sequence: Synthetic oligonucleotide
  Target: FXN; (+) strand; PAM type: YTN; PAM sequence: TTA
aatttaaatgtaaatagcta

SEQ ID NO: 32024 - DNA, 20 bp, Artificial Sequence
  Description of Artificial Sequence: Synthetic oligonucleotide
  Target: FXN; (+) strand; PAM type: YTN; PAM sequence: TTT
aaatgtaaatagctacgtgt

SEQ ID NO: 32025 - DNA, 20 bp, Artificial Sequence
  Description of Artificial Sequence: Synthetic oligonucleotide
  Target: FXN; (+) strand; PAM type: YTN; PAM sequence: TTA
aatgtaaatagctacgtgtg

SEQ ID NO: 32026 - DNA, 20 bp, Artificial Sequence
  Description of Artificial Sequence: Synthetic oligonucleotide
  Target: FXN; (+) strand; PAM type: YTN; PAM sequence: CTA
cgtgtggcttgttggctagc

SEQ ID NO: 32027 - DNA, 20 bp, Artificial Sequence
  Description of Artificial Sequence: Synthetic oligonucleotide
  Target: FXN; (+) strand; PAM type: YTN; PAM sequence: CTT
gttggctagcctattggaaa

SEQ ID NO: 32028 - DNA, 20 bp, Artificial Sequence
  Description of Artificial Sequence: Synthetic oligonucleotide
  Target: FXN; (+) strand; PAM type: YTN; PAM sequence: TTG
ttggctagcctattggaaaa

SEQ ID NO: 32029 - DNA, 20 bp, Artificial Sequence
  Description of Artificial Sequence: Synthetic oligonucleotide
  Target: FXN; (+) strand; PAM type: YTN; PAM sequence: TTG
gctagcctattggaaaacac

SEQ ID NO: 32030 - DNA, 20 bp, Artificial Sequence
  Description of Artificial Sequence: Synthetic oligonucleotide
  Target: FXN; (+) strand; PAM type: YTN; PAM sequence: CTA
gcctattggaaaacacgggc

SEQ ID NO: 32031 - DNA, 20 bp, Artificial Sequence
  Description of Artificial Sequence: Synthetic oligonucleotide
  Target: FXN; (+) strand; PAM type: YTN; PAM sequence: CTA
ttggaaaacacgggcttaga

SEQ ID NO: 32032 - DNA, 20 bp, Artificial Sequence
  Description of Artificial Sequence: Synthetic oligonucleotide
  Target: FXN; (+) strand; PAM type: YTN; PAM sequence: TTG
gaaaacacgggcttagagag

SEQ ID NO: 32033 - DNA, 20 bp, Artificial Sequence
  Description of Artificial Sequence: Synthetic oligonucleotide
  Target: FXN; (+) strand; PAM type: YTN; PAM sequence: CTT
agagagacacagggagaatc

SEQ ID NO: 32034 - DNA, 20 bp, Artificial Sequence
  Description of Artificial Sequence: Synthetic oligonucleotide
  Target: FXN; (+) strand; PAM type: YTN; PAM sequence: TTA
gagagacacagggagaatca

SEQ ID NO: 32035 - DNA, 20 bp, Artificial Sequence
  Description of Artificial Sequence: Synthetic oligonucleotide
  Target: FXN; (+) strand; PAM type: YTN; PAM sequence: CTG
taatgcactaaaagaaggta

SEQ ID NO: 32036 - DNA, 20 bp, Artificial Sequence
  Description of Artificial Sequence: Synthetic oligonucleotide
  Target: FXN; (+) strand; PAM type: YTN; PAM sequence: CTA
aaagaaggtaaaaaaaaaaa

SEQ ID NO: 32037 - DNA, 20 bp, Artificial Sequence
  Description of Artificial Sequence: Synthetic oligonucleotide
  Target: FXN; (+) strand; PAM type: YTN; PAM sequence: CTA
agaaatattcctaaaatact

SEQ ID NO: 32038 - DNA, 20 bp, Artificial Sequence
  Description of Artificial Sequence: Synthetic oligonucleotide
  Target: FXN; (+) strand; PAM type: YTN; PAM sequence: TTC
ctaaaatactttaatatagg

SEQ ID NO: 32039 - DNA, 20 bp, Artificial Sequence
  Description of Artificial Sequence: Synthetic oligonucleotide
  Target: FXN; (+) strand; PAM type: YTN; PAM sequence: CTA
aaatactttaatatagggct

SEQ ID NO: 32040 - DNA, 20 bp, Artificial Sequence
  Description of Artificial Sequence: Synthetic oligonucleotide
  Target: FXN; (+) strand; PAM type: YTN; PAM sequence: CTT
taatatagggctgggtgcgg

SEQ ID NO: 32041 - DNA, 20 bp, Artificial Sequence
  Description of Artificial Sequence: Synthetic oligonucleotide
  Target: FXN; (+) strand; PAM type: YTN; PAM sequence: TTT
aatatagggctgggtgcggt

SEQ ID NO: 32042 - DNA, 20 bp, Artificial Sequence
  Description of Artificial Sequence: Synthetic oligonucleotide
  Target: FXN; (+) strand; PAM type: YTN; PAM sequence: TTA
atatagggctgggtgcggtg

SEQ ID NO: 32043 - DNA, 20 bp, Artificial Sequence
  Description of Artificial Sequence: Synthetic oligonucleotide
  Target: FXN; (+) strand; PAM type: YTN; PAM sequence: CTG
ggtgcggtggctcacatcca

SEQ ID NO: 32044 - DNA, 20 bp, Artificial Sequence
  Description of Artificial Sequence: Synthetic oligonucleotide
  Target: FXN; (+) strand; PAM type: YTN; PAM sequence: CTC
acatccagcattttgggaag

SEQ ID NO: 32045 - DNA, 20 bp, Artificial Sequence
  Description of Artificial Sequence: Synthetic oligonucleotide
  Target: FXN; (+) strand; PAM type: YTN; PAM sequence: TTT
tgggaagctgaggagggcag

SEQ ID NO: 32046 - DNA, 20 bp, Artificial Sequence
  Description of Artificial Sequence: Synthetic oligonucleotide
  Target: FXN; (+) strand; PAM type: YTN; PAM sequence: TTT
gggaagctgaggagggcaga

SEQ ID NO: 32047 - DNA, 20 bp, Artificial Sequence
  Description of Artificial Sequence: Synthetic oligonucleotide
  Target: FXN; (+) strand; PAM type: YTN; PAM sequence: TTG
ggaagctgaggagggcagat

SEQ ID NO: 32048 - DNA, 20 bp, Artificial Sequence
  Description of Artificial Sequence: Synthetic oligonucleotide
  Target: FXN; (+) strand; PAM type: YTN; PAM sequence: CTG
aggagggcagatcacttgag

SEQ ID NO: 32049 - DNA, 20 bp, Artificial Sequence
  Description of Artificial Sequence: Synthetic oligonucleotide
  Target: FXN; (+) strand; PAM type: YTN; PAM sequence: CTT
gaggccaggagttcaagacc

SEQ ID NO: 32050 - DNA, 20 bp, Artificial Sequence
  Description of Artificial Sequence: Synthetic oligonucleotide
  Target: FXN; (+) strand; PAM type: YTN; PAM sequence: TTG
aggccaggagttcaagacca

SEQ ID NO: 32051 - DNA, 20 bp, Artificial Sequence
  Description of Artificial Sequence: Synthetic oligonucleotide
  Target: FXN; (+) strand; PAM type: YTN; PAM sequence: TTC
aagaccagcctggccaacat

SEQ ID NO: 32052 - DNA, 20 bp, Artificial Sequence
  Description of Artificial Sequence: Synthetic oligonucleotide
  Target: FXN; (+) strand; PAM type: YTN; PAM sequence: CTG
gccaacatggtgaaaccccg

SEQ ID NO: 32053 - DNA, 20 bp, Artificial Sequence
  Description of Artificial Sequence: Synthetic oligonucleotide
  Target: FXN; (+) strand; PAM type: YTN; PAM sequence: CTC
tactaaaaatacaaaaaatc

SEQ ID NO: 32054 - DNA, 20 bp, Artificial Sequence
  Description of Artificial Sequence: Synthetic oligonucleotide
  Target: FXN; (+) strand; PAM type: YTN; PAM sequence: CTA
ctaaaaatacaaaaaatcgg

SEQ ID NO: 32055 - DNA, 20 bp, Artificial Sequence
  Description of Artificial Sequence: Synthetic oligonucleotide
  Target: FXN; (+) strand; PAM type: YTN; PAM sequence: CTA
aaaatacaaaaaatcgggtg

SEQ ID NO: 32056 - DNA, 20 bp, Artificial Sequence
  Description of Artificial Sequence: Synthetic oligonucleotide
  Target: FXN; (+) strand; PAM type: YTN; PAM sequence: CTG
taatcccagctacgcgggag

SEQ ID NO: 32057 - DNA, 20 bp, Artificial Sequence
  Description of Artificial Sequence: Synthetic oligonucleotide
  Target: FXN; (+) strand; PAM type: YTN; PAM sequence: CTA
cgcgggaggctgaggcacga

SEQ ID NO: 32058 - DNA, 20 bp, Artificial Sequence
  Description of Artificial Sequence: Synthetic oligonucleotide
  Target: FXN; (+) strand; PAM type: YTN; PAM sequence: CTG
aggcacgagaatcactcgaa

SEQ ID NO: 32059 - DNA, 20 bp, Artificial Sequence
  Description of Artificial Sequence: Synthetic oligonucleotide
  Target: FXN; (+) strand; PAM type: YTN; PAM sequence: CTC
gaacccgggaggcgggggtt

SEQ ID NO: 32060 - DNA, 20 bp, Artificial Sequence
  Description of Artificial Sequence: Synthetic oligonucleotide
  Target: FXN; (+) strand; PAM type: YTN; PAM sequence: TTG
cagtgagccgagatcgtgcc

SEQ ID NO: 32061 - DNA, 20 bp, Artificial Sequence
  Description of Artificial Sequence: Synthetic oligonucleotide
  Target: FXN; (+) strand; PAM type: YTN; PAM sequence: CTG
cactccagcctgggcgacag

SEQ ID NO: 32062 - DNA, 20 bp, Artificial Sequence
  Description of Artificial Sequence: Synthetic oligonucleotide
  Target: FXN; (+) strand; PAM type: YTN; PAM sequence: CTC
cagcctgggcgacagagcga

SEQ ID NO: 32063 - DNA, 20 bp, Artificial Sequence
  Description of Artificial Sequence: Synthetic oligonucleotide
  Target: FXN; (+) strand; PAM type: YTN; PAM sequence: CTG
ggcgacagagcgagacttca

SEQ ID NO: 32064 - DNA, 20 bp, Artificial Sequence
  Description of Artificial Sequence: Synthetic oligonucleotide
  Target: FXN; (+) strand; PAM type: YTN; PAM sequence: CTT
catctcaaaaacaaaaaaca

SEQ ID NO: 32065 - DNA, 20 bp, Artificial Sequence
  Description of Artificial Sequence: Synthetic oligonucleotide
  Target: FXN; (+) strand; PAM type: YTN; PAM sequence: TTC
atctcaaaaacaaaaaacaa

SEQ ID NO: 32066 - DNA, 20 bp, Artificial Sequence
  Description of Artificial Sequence: Synthetic oligonucleotide
  Target: FXN; (+) strand; PAM type: YTN; PAM sequence: CTC
aaaaacaaaaaacaaaaacc

SEQ ID NO: 32067 - DNA, 20 bp, Artificial Sequence
  Description of Artificial Sequence: Synthetic oligonucleotide
  Target: FXN; (+) strand; PAM type: YTN; PAM sequence: CTT
cagcatgattatttaaccaa

SEQ ID NO: 32068 - DNA, 20 bp, Artificial Sequence
  Description of Artificial Sequence: Synthetic oligonucleotide
  Target: FXN; (+) strand; PAM type: YTN; PAM sequence: TTC
agcatgattatttaaccaaa

SEQ ID NO: 32069 - DNA, 20 bp, Artificial Sequence
  Description of Artificial Sequence: Synthetic oligonucleotide
  Target: FXN; (+) strand; PAM type: YTN; PAM sequence: TTA
tttaaccaaaatgcaggtta

SEQ ID NO: 32070 - DNA, 20 bp, Artificial Sequence
  Description of Artificial Sequence: Synthetic oligonucleotide
  Target: FXN; (+) strand; PAM type: YTN; PAM sequence: TTT
aaccaaaatgcaggttagtt

SEQ ID NO: 32071 - DNA, 20 bp, Artificial Sequence
  Description of Artificial Sequence: Synthetic oligonucleotide
  Target: FXN; (+) strand; PAM type: YTN; PAM sequence: TTA
accaaaatgcaggttagttg

SEQ ID NO: 32072 - DNA, 20 bp, Artificial Sequence
  Description of Artificial Sequence: Synthetic oligonucleotide
  Target: FXN; (+) strand; PAM type: YTN; PAM sequence: TTA
gttgttcaccggatgcagag

SEQ ID NO: 32073 - DNA, 20 bp, Artificial Sequence
  Description of Artificial Sequence: Synthetic oligonucleotide
  Target: FXN; (+) strand; PAM type: YTN; PAM sequence: TTG
ttcaccggatgcagagtcca

SEQ ID NO: 32074 - DNA, 20 bp, Artificial Sequence
  Description of Artificial Sequence: Synthetic oligonucleotide
  Target: FXN; (+) strand; PAM type: YTN; PAM sequence: TTC
accggatgcagagtccaatt

SEQ ID NO: 32075 - DNA, 20 bp, Artificial Sequence
  Description of Artificial Sequence: Synthetic oligonucleotide
  Target: FXN; (+) strand; PAM type: YTN; PAM sequence: TTA
acaagagcaaggcctggtac

SEQ ID NO: 32076 - DNA, 20 bp, Artificial Sequence
  Description of Artificial Sequence: Synthetic oligonucleotide
  Target: FXN; (+) strand; PAM type: YTN; PAM sequence: CTG
gtaccaaaaaaagtgaattt

SEQ ID NO: 32077 - DNA, 20 bp, Artificial Sequence
  Description of Artificial Sequence: Synthetic oligonucleotide
  Target: FXN; (+) strand; PAM type: YTN; PAM sequence: TTT
actccgaaactagcttgggt

SEQ ID NO: 32078 - DNA, 20 bp, Artificial Sequence
  Description of Artificial Sequence: Synthetic oligonucleotide
  Target: FXN; (+) strand; PAM type: YTN; PAM sequence: TTA
ctccgaaactagcttgggtg

SEQ ID NO: 32079 - DNA, 20 bp, Artificial Sequence
  Description of Artificial Sequence: Synthetic oligonucleotide
  Target: FXN; (+) strand; PAM type: YTN; PAM sequence: CTC
cgaaactagcttgggtgagg

SEQ ID NO: 32080 - DNA, 20 bp, Artificial Sequence
  Description of Artificial Sequence: Synthetic oligonucleotide
  Target: FXN; (+) strand; PAM type: YTN; PAM sequence: CTA
gcttgggtgaggggtacaaa

SEQ ID NO: 32081 - DNA, 20 bp, Artificial Sequence
  Description of Artificial Sequence: Synthetic oligonucleotide
  Target: FXN; (+) strand; PAM type: YTN; PAM sequence: CTT
gggtgaggggtacaaagcat

SEQ ID NO: 32082 - DNA, 20 bp, Artificial Sequence
  Description of Artificial Sequence: Synthetic oligonucleotide
  Target: FXN; (+) strand; PAM type: YTN; PAM sequence: TTG
ggtgaggggtacaaagcatc

SEQ ID NO: 32083 - DNA, 20 bp, Artificial Sequence
  Description of Artificial Sequence: Synthetic oligonucleotide
  Target: FXN; (+) strand; PAM type: YTN; PAM sequence: CTG
cctttctttaaaagtgctgc

SEQ ID NO: 32084 - DNA, 20 bp, Artificial Sequence
  Description of Artificial Sequence: Synthetic oligonucleotide
  Target: FXN; (+) strand; PAM type: YTN; PAM sequence: CTT
tctttaaaagtgctgcttcc

SEQ ID NO: 32085 - DNA, 20 bp, Artificial Sequence
  Description of Artificial Sequence: Synthetic oligonucleotide
  Target: FXN; (+) strand; PAM type: YTN; PAM sequence: TTT
ctttaaaagtgctgcttccc

SEQ ID NO: 32086 - DNA, 20 bp, Artificial Sequence
  Description of Artificial Sequence: Synthetic oligonucleotide
  Target: FXN; (+) strand; PAM type: YTN; PAM sequence: TTC
tttaaaagtgctgcttcccc

SEQ ID NO: 32087 - DNA, 20 bp, Artificial Sequence
  Description of Artificial Sequence: Synthetic oligonucleotide
  Target: FXN; (+) strand; PAM type: YTN; PAM sequence: CTT
taaaagtgctgcttcccctt

SEQ ID NO: 32088 - DNA, 20 bp, Artificial Sequence
  Description of Artificial Sequence: Synthetic oligonucleotide
  Target: FXN; (+) strand; PAM type: YTN; PAM sequence: TTT
aaaagtgctgcttccccttg

SEQ ID NO: 32089 - DNA, 20 bp, Artificial Sequence
  Description of Artificial Sequence: Synthetic oligonucleotide
  Target: FXN; (+) strand; PAM type: YTN; PAM sequence: TTA
aaagtgctgcttccccttgg

SEQ ID NO: 32090 - DNA, 20 bp, Artificial Sequence
  Description of Artificial Sequence: Synthetic oligonucleotide
  Target: FXN; (+) strand; PAM type: YTN; PAM sequence: CTG
cttccccttggaagtagaaa

SEQ ID NO: 32091 - DNA, 20 bp, Artificial Sequence
  Description of Artificial Sequence: Synthetic oligonucleotide
  Target: FXN; (+) strand; PAM type: YTN; PAM sequence: CTT
ccccttggaagtagaaagtg

SEQ ID NO: 32092 - DNA, 20 bp, Artificial Sequence
  Description of Artificial Sequence: Synthetic oligonucleotide
  Target: FXN; (+) strand; PAM type: YTN; PAM sequence: TTC
cccttggaagtagaaagtgg

SEQ ID NO: 32093 - DNA, 20 bp, Artificial Sequence
  Description of Artificial Sequence: Synthetic oligonucleotide
  Target: FXN; (+) strand; PAM type: YTN; PAM sequence: CTT
ggaagtagaaagtggacact

SEQ ID NO: 32094 - DNA, 20 bp, Artificial Sequence
  Description of Artificial Sequence: Synthetic oligonucleotide
  Target: FXN; (+) strand; PAM type: YTN; PAM sequence: TTG
gaagtagaaagtggacactt

SEQ ID NO: 32095 - DNA, 20 bp, Artificial Sequence
  Description of Artificial Sequence: Synthetic oligonucleotide
  Target: FXN; (+) strand; PAM type: YTN; PAM sequence: CTT
ttataaggtaaggggggaag

SEQ ID NO: 32096 - DNA, 20 bp, Artificial Sequence
  Description of Artificial Sequence: Synthetic oligonucleotide
  Target: FXN; (+) strand; PAM type: YTN; PAM sequence: TTT
tataaggtaaggggggaagt

SEQ ID NO: 32097 - DNA, 20 bp, Artificial Sequence
  Description of Artificial Sequence: Synthetic oligonucleotide
  Target: FXN; (+) strand; PAM type: YTN; PAM sequence: TTT
ataaggtaaggggggaagtg

SEQ ID NO: 32098 - DNA, 20 bp, Artificial Sequence
  Description of Artificial Sequence: Synthetic oligonucleotide
  Target: FXN; (+) strand; PAM type: YTN; PAM sequence: TTA
taaggtaaggggggaagtgt

SEQ ID NO: 32099 - DNA, 20 bp, Artificial Sequence
  Description of Artificial Sequence: Synthetic oligonucleotide
  Target: FXN; (+) strand; PAM type: YTN; PAM sequence: CTC
tgctagttccgtgcatactc

SEQ ID NO: 32100 - DNA, 20 bp, Artificial Sequence
  Description of Artificial Sequence: Synthetic oligonucleotide
  Target: FXN; (+) strand; PAM type: YTN; PAM sequence: CTG
ctagttccgtgcatactcta

SEQ ID NO: 32101 - DNA, 20 bp, Artificial Sequence
  Description of Artificial Sequence: Synthetic oligonucleotide
  Target: FXN; (+) strand; PAM type: YTN; PAM sequence: CTA
gttccgtgcatactctacag

SEQ ID NO: 32102 - DNA, 20 bp, Artificial Sequence
  Description of Artificial Sequence: Synthetic oligonucleotide
  Target: FXN; (+) strand; PAM type: YTN; PAM sequence: TTC
cgtgcatactctacaggaca

SEQ ID NO: 32103 - DNA, 20 bp, Artificial Sequence
  Description of Artificial Sequence: Synthetic oligonucleotide
  Target: FXN; (+) strand; PAM type: YTN; PAM sequence: CTC
tacaggacagttgacttggc

SEQ ID NO: 32104 - DNA, 20 bp, Artificial Sequence
  Description of Artificial Sequence: Synthetic oligonucleotide
  Target: FXN; (+) strand; PAM type: YTN; PAM sequence: CTA
caggacagttgacttggcac

SEQ ID NO: 32105 - DNA, 20 bp, Artificial Sequence
  Description of Artificial Sequence: Synthetic oligonucleotide
  Target: FXN; (+) strand; PAM type: YTN; PAM sequence: TTG
acttggcaccttcctggtta

SEQ ID NO: 32106 - DNA, 20 bp, Artificial Sequence
  Description of Artificial Sequence: Synthetic oligonucleotide
  Target: FXN; (+) strand; PAM type: YTN; PAM sequence: CTT
ggcaccttcctggttagtaa

SEQ ID NO: 32107 - DNA, 20 bp, Artificial Sequence
  Description of Artificial Sequence: Synthetic oligonucleotide
  Target: FXN; (+) strand; PAM type: YTN; PAM sequence: TTG
gcaccttcctggttagtaat

SEQ ID NO: 32108 - DNA, 20 bp, Artificial Sequence
  Description of Artificial Sequence: Synthetic oligonucleotide
  Target: FXN; (+) strand; PAM type: YTN; PAM sequence: CTT
cctggttagtaataagctgt

SEQ ID NO: 32109 - DNA, 20 bp, Artificial Sequence
  Description of Artificial Sequence: Synthetic oligonucleotide
  Target: FXN; (+) strand; PAM type: YTN; PAM sequence: TTC
ctggttagtaataagctgta

SEQ ID NO: 32110 - DNA, 20 bp, Artificial Sequence
  Description of Artificial Sequence: Synthetic oligonucleotide
  Target: FXN; (+) strand; PAM type: YTN; PAM sequence: CTG
gttagtaataagctgtagca

SEQ ID NO: 32111 - DNA, 20 bp, Artificial Sequence
  Description of Artificial Sequence: Synthetic oligonucleotide
  Target: FXN; (+) strand; PAM type: YTN; PAM sequence: TTA
gtaataagctgtagcagtgg

SEQ ID NO: 32112 - DNA, 20 bp, Artificial Sequence
  Description of Artificial Sequence: Synthetic oligonucleotide
  Target: FXN; (+) strand; PAM type: YTN; PAM sequence: CTG
tagcagtggccaagtgggca

SEQ ID NO: 32113 - DNA, 20 bp, Artificial Sequence
  Description of Artificial Sequence: Synthetic oligonucleotide
  Target: FXN; (+) strand; PAM type: YTN; PAM sequence: CTT
tcagtatgccctcccagtga

SEQ ID NO: 32114 - DNA, 20 bp, Artificial Sequence
  Description of Artificial Sequence: Synthetic oligonucleotide
  Target: FXN; (+) strand; PAM type: YTN; PAM sequence: TTT
cagtatgccctcccagtgaa

SEQ ID NO: 32115 - DNA, 20 bp, Artificial Sequence
  Description of Artificial Sequence: Synthetic oligonucleotide
  Target: FXN; (+) strand; PAM type: YTN; PAM sequence: TTC
agtatgccctcccagtgaat

SEQ ID NO: 32116 - DNA, 20 bp, Artificial Sequence
  Description of Artificial Sequence: Synthetic oligonucleotide
  Target: FXN; (+) strand; PAM type: YTN; PAM sequence: CTC
ccagtgaatgaaagtcctga

SEQ ID NO: 32117 - DNA, 20 bp, Artificial Sequence
  Description of Artificial Sequence: Synthetic oligonucleotide
  Target: FXN; (+) strand; PAM type: YTN; PAM sequence: CTG
aggcaacccccaagggtgga

SEQ ID NO: 32118 - DNA, 20 bp, Artificial Sequence
  Description of Artificial Sequence: Synthetic oligonucleotide
  Target: FXN; (+) strand; PAM type: YTN; PAM sequence: CTG
gaggtgaaagttccgtgatg

SEQ ID NO: 32119 - DNA, 20 bp, Artificial Sequence
  Description of Artificial Sequence: Synthetic oligonucleotide
  Target: FXN; (+) strand; PAM type: YTN; PAM sequence: TTC
cgtgatgggtttgctttggt

SEQ ID NO: 32120 - DNA, 20 bp, Artificial Sequence
  Description of Artificial Sequence: Synthetic oligonucleotide
  Target: FXN; (+) strand; PAM type: YTN; PAM sequence: TTT
gctttggtctgcgaatctac

SEQ ID NO: 32121 - DNA, 20 bp, Artificial Sequence
  Description of Artificial Sequence: Synthetic oligonucleotide
  Target: FXN; (+) strand; PAM type: YTN; PAM sequence: TTG
ctttggtctgcgaatctact

SEQ ID NO: 32122 - DNA, 20 bp, Artificial Sequence
  Description of Artificial Sequence: Synthetic oligonucleotide
  Target: FXN; (+) strand; PAM type: YTN; PAM sequence: CTT
tggtctgcgaatctactgtc

SEQ ID NO: 32123 - DNA, 20 bp, Artificial Sequence
  Description of Artificial Sequence: Synthetic oligonucleotide
  Target: FXN; (+) strand; PAM type: YTN; PAM sequence: TTT
ggtctgcgaatctactgtca

SEQ ID NO: 32124 - DNA, 20 bp, Artificial Sequence
  Description of Artificial Sequence: Synthetic oligonucleotide
  Target: FXN; (+) strand; PAM type: YTN; PAM sequence: TTG
gtctgcgaatctactgtcat

SEQ ID NO: 32125 - DNA, 20 bp, Artificial Sequence
  Description of Artificial Sequence: Synthetic oligonucleotide
  Target: FXN; (+) strand; PAM type: YTN; PAM sequence: CTG
cgaatctactgtcatgtgga

SEQ ID NO: 32126 - DNA, 20 bp, Artificial Sequence
  Description of Artificial Sequence: Synthetic oligonucleotide
  Target: FXN; (+) strand; PAM type: YTN; PAM sequence: CTA
ctgtcatgtggagagatctg

SEQ ID NO: 32127 - DNA, 20 bp, Artificial Sequence
  Description of Artificial Sequence: Synthetic oligonucleotide
  Target: FXN; (+) strand; PAM type: YTN; PAM sequence: CTG
tcatgtggagagatctgtgc

SEQ ID NO: 32128 - DNA, 20 bp, Artificial Sequence
  Description of Artificial Sequence: Synthetic oligonucleotide
  Target: FXN; (+) strand; PAM type: YTN; PAM sequence: CTG
tgctctggaagagcatacag

SEQ ID NO: 32129 - DNA, 20 bp, Artificial Sequence
  Description of Artificial Sequence: Synthetic oligonucleotide
  Target: FXN; (+) strand; PAM type: YTN; PAM sequence: CTC
tggaagagcatacagttaga

SEQ ID NO: 32130 - DNA, 20 bp, Artificial Sequence
  Description of Artificial Sequence: Synthetic oligonucleotide
  Target: FXN; (+) strand; PAM type: YTN; PAM sequence: CTG
gaagagcatacagttagaaa

SEQ ID NO: 32131 - DNA, 20 bp, Artificial Sequence
  Description of Artificial Sequence: Synthetic oligonucleotide
  Target: FXN; (+) strand; PAM type: YTN; PAM sequence: TTA
gaaaagcttgccctgaaggg

SEQ ID NO: 32132 - DNA, 20 bp, Artificial Sequence
  Description of Artificial Sequence: Synthetic oligonucleotide
  Target: FXN; (+) strand; PAM type: YTN; PAM sequence: CTT
gccctgaagggaatgtatgg

SEQ ID NO: 32133 - DNA, 20 bp, Artificial Sequence
  Description of Artificial Sequence: Synthetic oligonucleotide
  Target: FXN; (+) strand; PAM type: YTN; PAM sequence: TTG
ccctgaagggaatgtatggt

SEQ ID NO: 32134 - DNA, 20 bp, Artificial Sequence
  Description of Artificial Sequence: Synthetic oligonucleotide
  Target: FXN; (+) strand; PAM type: YTN; PAM sequence: CTG
aagggaatgtatggtgaagg

SEQ ID NO: 32135 - DNA, 20 bp, Artificial Sequence
  Description of Artificial Sequence: Synthetic oligonucleotide
  Target: FXN; (+) strand; PAM type: YTN; PAM sequence: TTA
tatttgcatttctgaagggc

SEQ ID NO: 32136 - DNA, 20 bp, Artificial Sequence
  Description of Artificial Sequence: Synthetic oligonucleotide
  Target: FXN; (+) strand; PAM type: YTN; PAM sequence: TTT
gcatttctgaagggctaagt

SEQ ID NO: 32137 - DNA, 20 bp, Artificial Sequence
  Description of Artificial Sequence: Synthetic oligonucleotide
  Target: FXN; (+) strand; PAM type: YTN; PAM sequence: TTG
catttctgaagggctaagta

SEQ ID NO: 32138 - DNA, 20 bp, Artificial Sequence
  Description of Artificial Sequence: Synthetic oligonucleotide
  Target: FXN; (+) strand; PAM type: YTN; PAM sequence: TTT
ctgaagggctaagtaggaaa

SEQ ID NO: 32139 - DNA, 20 bp, Artificial Sequence
  Description of Artificial Sequence: Synthetic oligonucleotide
  Target: FXN; (+) strand; PAM type: YTN; PAM sequence: TTC
tgaagggctaagtaggaaac

SEQ ID NO: 32140 - DNA, 20 bp, Artificial Sequence
  Description of Artificial Sequence: Synthetic oligonucleotide
  Target: FXN; (+) strand; PAM type: YTN; PAM sequence: CTG
aagggctaagtaggaaaccg

SEQ ID NO: 32141 - DNA, 20 bp, Artificial Sequence
  Description of Artificial Sequence: Synthetic oligonucleotide
  Target: FXN; (+) strand; PAM type: YTN; PAM sequence: CTA
agtaggaaaccgggaaccag

SEQ ID NO: 32142 - DNA, 20 bp, Artificial Sequence
  Description of Artificial Sequence: Synthetic oligonucleotide
  Target: FXN; (+) strand; PAM type: YTN; PAM sequence: TTT
tttttaagaaaagcaacata

SEQ ID NO: 32143 - DNA, 20 bp, Artificial Sequence
  Description of Artificial Sequence: Synthetic oligonucleotide
  Target: FXN; (+) strand; PAM type: YTN; PAM sequence: TTT
ttttaagaaaagcaacatat

SEQ ID NO: 32144 - DNA, 20 bp, Artificial Sequence
  Description of Artificial Sequence: Synthetic oligonucleotide
  Target: FXN; (+) strand; PAM type: YTN; PAM sequence: TTT
tttaagaaaagcaacatatt

SEQ ID NO: 32145 - DNA, 20 bp, Artificial Sequence
  Description of Artificial Sequence: Synthetic oligonucleotide
  Target: FXN; (+) strand; PAM type: YTN; PAM sequence: TTT
ttaagaaaagcaacatattc

SEQ ID NO: 32146 - DNA, 20 bp, Artificial Sequence
  Description of Artificial Sequence: Synthetic oligonucleotide
  Target: FXN; (+) strand; PAM type: YTN; PAM sequence: TTT
taagaaaagcaacatattcc

SEQ ID NO: 32147 - DNA, 20 bp, Artificial Sequence
  Description of Artificial Sequence: Synthetic oligonucleotide
  Target: FXN; (+) strand; PAM type: YTN; PAM sequence: TTT
aagaaaagcaacatattccc

SEQ ID NO: 32148 - DNA, 20 bp, Artificial Sequence
  Description of Artificial Sequence: Synthetic oligonucleotide
  Target: FXN; (+) strand; PAM type: YTN; PAM sequence: TTA
agaaaagcaacatattccct

SEQ ID NO: 32149 - DNA, 20 bp, Artificial Sequence
  Description of Artificial Sequence: Synthetic oligonucleotide
  Target: FXN; (+) strand; PAM type: YTN; PAM sequence: TTC
cctttttcttagaaaaaatg

SEQ ID NO: 32150 - DNA, 20 bp, Artificial Sequence
  Description of Artificial Sequence: Synthetic oligonucleotide
  Target: FXN; (+) strand; PAM type: YTN; PAM sequence: CTT
tttcttagaaaaaatggagc

SEQ ID NO: 32151 - DNA, 20 bp, Artificial Sequence
  Description of Artificial Sequence: Synthetic oligonucleotide
  Target: FXN; (+) strand; PAM type: YTN; PAM sequence: TTT
ttcttagaaaaaatggagca

SEQ ID NO: 32152 - DNA, 20 bp, Artificial Sequence
  Description of Artificial Sequence: Synthetic oligonucleotide
  Target: FXN; (+) strand; PAM type: YTN; PAM sequence: TTT
tcttagaaaaaatggagcac

SEQ ID NO: 32153 - DNA, 20 bp, Artificial Sequence
  Description of Artificial Sequence: Synthetic oligonucleotide
  Target: FXN; (+) strand; PAM type: YTN; PAM sequence: TTT
cttagaaaaaatggagcact

SEQ ID NO: 32154 - DNA, 20 bp, Artificial Sequence
  Description of Artificial Sequence: Synthetic oligonucleotide
  Target: FXN; (+) strand; PAM type: YTN; PAM sequence: TTC
ttagaaaaaatggagcactc

SEQ ID NO: 32155 - DNA, 20 bp, Artificial Sequence
  Description of Artificial Sequence: Synthetic oligonucleotide
  Target: FXN; (+) strand; PAM type: YTN; PAM sequence: CTT
agaaaaaatggagcactcgg

SEQ ID NO: 32156 - DNA, 20 bp, Artificial Sequence
  Description of Artificial Sequence: Synthetic oligonucleotide
  Target: FXN; (+) strand; PAM type: YTN; PAM sequence: TTA
gaaaaaatggagcactcggt

SEQ ID NO: 32157 - DNA, 20 bp, Artificial Sequence
  Description of Artificial Sequence: Synthetic oligonucleotide
  Target: FXN; (+) strand; PAM type: YTN; PAM sequence: CTC
ggttacaggcactcgaatgt

SEQ ID NO: 32158 - DNA, 20 bp, Artificial Sequence
  Description of Artificial Sequence: Synthetic oligonucleotide
  Target: FXN; (+) strand; PAM type: YTN; PAM sequence: TTA
caggcactcgaatgtagaag

SEQ ID NO: 32159 - DNA, 20 bp, Artificial Sequence
  Description of Artificial Sequence: Synthetic oligonucleotide
  Target: FXN; (+) strand; PAM type: YTN; PAM sequence: CTC
gaatgtagaagtagcaatat

SEQ ID NO: 32160 - DNA, 20 bp, Artificial Sequence
  Description of Artificial Sequence: Synthetic oligonucleotide
  Target: FXN; (+) strand; PAM type: YTN; PAM sequence: TTA
tgcattaatgggttataatt

SEQ ID NO: 32161 - DNA, 20 bp, Artificial Sequence
  Description of Artificial Sequence: Synthetic oligonucleotide
  Target: FXN; (+) strand; PAM type: YTN; PAM sequence: TTA
atgggttataattcactgaa

SEQ ID NO: 32162 - DNA, 20 bp, Artificial Sequence
  Description of Artificial Sequence: Synthetic oligonucleotide
  Target: FXN; (+) strand; PAM type: YTN; PAM sequence: TTA
taattcactgaaaaatagta

SEQ ID NO: 32163 - DNA, 20 bp, Artificial Sequence
  Description of Artificial Sequence: Synthetic oligonucleotide
  Target: FXN; (+) strand; PAM type: YTN; PAM sequence: TTC
actgaaaaatagtaacgtac

SEQ ID NO: 32164 - DNA, 20 bp, Artificial Sequence
  Description of Artificial Sequence: Synthetic oligonucleotide
  Target: FXN; (+) strand; PAM type: YTN; PAM sequence: CTG
aaaaatagtaacgtacttct

SEQ ID NO: 32165 - DNA, 20 bp, Artificial Sequence
  Description of Artificial Sequence: Synthetic oligonucleotide
  Target: FXN; (+) strand; PAM type: YTN; PAM sequence: CTT
cttaactttggctttcagag

SEQ ID NO: 32166 - DNA, 20 bp, Artificial Sequence
  Description of Artificial Sequence: Synthetic oligonucleotide
  Target: FXN; (+) strand; PAM type: YTN; PAM sequence: TTC
ttaactttggctttcagagt

SEQ ID NO: 32167 - DNA, 20 bp, Artificial Sequence
  Description of Artificial Sequence: Synthetic oligonucleotide
  Target: FXN; (+) strand; PAM type: YTN; PAM sequence: CTT
aactttggctttcagagttc

SEQ ID NO: 32168 - DNA, 20 bp, Artificial Sequence
  Description of Artificial Sequence: Synthetic oligonucleotide
  Target: FXN; (+) strand; PAM type: YTN; PAM sequence: TTA
actttggctttcagagttcg

SEQ ID NO: 32169 - DNA, 20 bp, Artificial Sequence
  Description of Artificial Sequence: Synthetic oligonucleotide
  Target: FXN; (+) strand; PAM type: YTN; PAM sequence: CTT
tggctttcagagttcgaacc

SEQ ID NO: 32170 - DNA, 20 bp, Artificial Sequence
  Description of Artificial Sequence: Synthetic oligonucleotide
  Target: FXN; (+) strand; PAM type: YTN; PAM sequence: TTT
ggctttcagagttcgaacca

SEQ ID NO: 32171 - DNA, 20 bp, Artificial Sequence
  Description of Artificial Sequence: Synthetic oligonucleotide
  Target: FXN; (+) strand; PAM type: YTN; PAM sequence: TTG
gctttcagagttcgaaccaa

SEQ ID NO: 32172 - DNA, 20 bp, Artificial Sequence
  Description of Artificial Sequence: Synthetic oligonucleotide
  Target: FXN; (+) strand; PAM type: YTN; PAM sequence: CTT
tcagagttcgaaccaacgtg

SEQ ID NO: 32173 - DNA, 20 bp, Artificial Sequence
  Description of Artificial Sequence: Synthetic oligonucleotide
  Target: FXN; (+) strand; PAM type: YTN; PAM sequence: TTT
cagagttcgaaccaacgtgg

SEQ ID NO: 32174 - DNA, 20 bp, Artificial Sequence
  Description of Artificial Sequence: Synthetic oligonucleotide
  Target: FXN; (+) strand; PAM type: YTN; PAM sequence: TTC
agagttcgaaccaacgtggc

SEQ ID NO: 32175 - DNA, 20 bp, Artificial Sequence
  Description of Artificial Sequence: Synthetic oligonucleotide
  Target: FXN; (+) strand; PAM type: YTN; PAM sequence: TTC
gaaccaacgtggcctcaacc

SEQ ID NO: 32176 - DNA, 20 bp, Artificial Sequence
  Description of Artificial Sequence: Synthetic oligonucleotide
  Target: FXN; (+) strand; PAM type: YTN; PAM sequence: CTC
aaccagatttggaatgtcaa

SEQ ID NO: 32177 - DNA, 20 bp, Artificial Sequence
  Description of Artificial Sequence: Synthetic oligonucleotide
  Target: FXN; (+) strand; PAM type: YTN; PAM sequence: TTT
ggaatgtcaaaaagcagagt

SEQ ID NO: 32178 - DNA, 20 bp, Artificial Sequence
  Description of Artificial Sequence: Synthetic oligonucleotide
  Target: FXN; (+) strand; PAM type: YTN; PAM sequence: TTG
gaatgtcaaaaagcagagtg

SEQ ID NO: 32179 - DNA, 20 bp, Artificial Sequence
  Description of Artificial Sequence: Synthetic oligonucleotide
  Target: FXN; (+) strand; PAM type: YTN; PAM sequence: CTA
tttgatgaatttgaggaaat

SEQ ID NO: 32180 - DNA, 20 bp, Artificial Sequence
  Description of Artificial Sequence: Synthetic oligonucleotide
  Target: FXN; (+) strand; PAM type: YTN; PAM sequence: TTT
gatgaatttgaggaaatctg

SEQ ID NO: 32181 - DNA, 20 bp, Artificial Sequence
  Description of Artificial Sequence: Synthetic oligonucleotide
  Target: FXN; (+) strand; PAM type: YTN; PAM sequence: TTG
atgaatttgaggaaatctgg

SEQ ID NO: 32182 - DNA, 20 bp, Artificial Sequence
  Description of Artificial Sequence: Synthetic oligonucleotide
  Target: FXN; (+) strand; PAM type: YTN; PAM sequence: TTT
gaggaaatctggaactttgg

SEQ ID NO: 32183 - DNA, 20 bp, Artificial Sequence
  Description of Artificial Sequence: Synthetic oligonucleotide
  Target: FXN; (+) strand; PAM type: YTN; PAM sequence: TTG
aggaaatctggaactttggg

SEQ ID NO: 32184 - DNA, 20 bp, Artificial Sequence
  Description of Artificial Sequence: Synthetic oligonucleotide
  Target: FXN; (+) strand; PAM type: YTN; PAM sequence: CTG
gaactttgggccacccaggg

SEQ ID NO: 32185 - DNA, 20 bp, Artificial Sequence
  Description of Artificial Sequence: Synthetic oligonucleotide
  Target: FXN; (+) strand; PAM type: YTN; PAM sequence: CTT
tgggccacccagggtaagat

SEQ ID NO: 32186 - DNA, 20 bp, Artificial Sequence
  Description of Artificial Sequence: Synthetic oligonucleotide
  Target: FXN; (+) strand; PAM type: YTN; PAM sequence: TTT
gggccacccagggtaagata

SEQ ID NO: 32187 - DNA, 20 bp, Artificial Sequence
  Description of Artificial Sequence: Synthetic oligonucleotide
  Target: FXN; (+) strand; PAM type: YTN; PAM sequence: TTG
ggccacccagggtaagataa

SEQ ID NO: 32188 - DNA, 20 bp, Artificial Sequence
  Description of Artificial Sequence: Synthetic oligonucleotide
  Target: FXN; (+) strand; PAM type: YTN; PAM sequence: CTT
ccacgtcataggtatcttcc

SEQ ID NO: 32189 - DNA, 20 bp, Artificial Sequence
  Description of Artificial Sequence: Synthetic oligonucleotide
  Target: FXN; (+) strand; PAM type: YTN; PAM sequence: TTC
cacgtcataggtatcttcct

SEQ ID NO: 32190 - DNA, 20 bp, Artificial Sequence
  Description of Artificial Sequence: Synthetic oligonucleotide
  Target: FXN; (+) strand; PAM type: YTN; PAM sequence: CTT
cctctctccttccctgcctc

SEQ ID NO: 32191 - DNA, 20 bp, Artificial Sequence
  Description of Artificial Sequence: Synthetic oligonucleotide
  Target: FXN; (+) strand; PAM type: YTN; PAM sequence: TTC
ctctctccttccctgcctct

SEQ ID NO: 32192 - DNA, 20 bp, Artificial Sequence
  Description of Artificial Sequence: Synthetic oligonucleotide
  Target: FXN; (+) strand; PAM type: YTN; PAM sequence: CTC
tctccttccctgcctctccc

SEQ ID NO: 32193 - DNA, 20 bp, Artificial Sequence
  Description of Artificial Sequence: Synthetic oligonucleotide
  Target: FXN; (+) strand; PAM type: YTN; PAM sequence: CTC
tccttccctgcctctcccat

SEQ ID NO: 32194 - DNA, 20 bp, Artificial Sequence
  Description of Artificial Sequence: Synthetic oligonucleotide
  Target: FXN; (+) strand; PAM type: YTN; PAM sequence: CTC
cttccctgcctctcccatta

SEQ ID NO: 32195 - DNA, 20 bp, Artificial Sequence
  Description of Artificial Sequence: Synthetic oligonucleotide
  Target: FXN; (+) strand; PAM type: YTN; PAM sequence: CTT
ccctgcctctcccattagaa

SEQ ID NO: 32196 - DNA, 20 bp, Artificial Sequence
  Description of Artificial Sequence: Synthetic oligonucleotide
  Target: FXN; (+) strand; PAM type: YTN; PAM sequence: TTC
cctgcctctcccattagaac

SEQ ID NO: 32197 - DNA, 20 bp, Artificial Sequence
  Description of Artificial Sequence: Synthetic oligonucleotide
  Target: FXN; (+) strand; PAM type: YTN; PAM sequence: CTG
cctctcccattagaacctgg

SEQ ID NO: 32198 - DNA, 20 bp, Artificial Sequence
  Description of Artificial Sequence: Synthetic oligonucleotide
  Target: FXN; (+) strand; PAM type: YTN; PAM sequence: CTC
tcccattagaacctggtttt

SEQ ID NO: 32199 - DNA, 20 bp, Artificial Sequence
  Description of Artificial Sequence: Synthetic oligonucleotide
  Target: FXN; (+) strand; PAM type: YTN; PAM sequence: CTC
ccattagaacctggttttct

SEQ ID NO: 32200 - DNA, 20 bp, Artificial Sequence
  Description of Artificial Sequence: Synthetic oligonucleotide
  Target: FXN; (+) strand; PAM type: YTN; PAM sequence: TTA
gaacctggttttcttcctga

SEQ ID NO: 32201 - DNA, 20 bp, Artificial Sequence
  Description of Artificial Sequence: Synthetic oligonucleotide
  Target: FXN; (+) strand; PAM type: YTN; PAM sequence: CTG
gttttcttcctgagcagcaa

SEQ ID NO: 32202 - DNA, 20 bp, Artificial Sequence
  Description of Artificial Sequence: Synthetic oligonucleotide
  Target: FXN; (+) strand; PAM type: YTN; PAM sequence: TTT
tcttcctgagcagcaacaat

SEQ ID NO: 32203 - DNA, 20 bp, Artificial Sequence
  Description of Artificial Sequence: Synthetic oligonucleotide
  Target: FXN; (+) strand; PAM type: YTN; PAM sequence: TTT
cttcctgagcagcaacaatc

SEQ ID NO: 32204 - DNA, 20 bp, Artificial Sequence
  Description of Artificial Sequence: Synthetic oligonucleotide
  Target: FXN; (+) strand; PAM type: YTN; PAM sequence: TTC
ttcctgagcagcaacaatct

SEQ ID NO: 32205 - DNA, 20 bp, Artificial Sequence
  Description of Artificial Sequence: Synthetic oligonucleotide
  Target: FXN; (+) strand; PAM type: YTN; PAM sequence: CTT
cctgagcagcaacaatctta

SEQ ID NO: 32206 - DNA, 20 bp, Artificial Sequence
  Description of Artificial Sequence: Synthetic oligonucleotide
  Target: FXN; (+) strand; PAM type: YTN; PAM sequence: TTC
ctgagcagcaacaatcttag

SEQ ID NO: 32207 - DNA, 20 bp, Artificial Sequence
  Description of Artificial Sequence: Synthetic oligonucleotide
  Target: FXN; (+) strand; PAM type: YTN; PAM sequence: CTG
agcagcaacaatcttaggca

SEQ ID NO: 32208 - DNA, 20 bp, Artificial Sequence
  Description of Artificial Sequence: Synthetic oligonucleotide
  Target: FXN; (+) strand; PAM type: YTN; PAM sequence: CTT
aggcatctttccatgtgact

SEQ ID NO: 32209 - DNA, 20 bp, Artificial Sequence
  Description of Artificial Sequence: Synthetic oligonucleotide
  Target: FXN; (+) strand; PAM type: YTN; PAM sequence: TTA
ggcatctttccatgtgactg

SEQ ID NO: 32210 - DNA, 20 bp, Artificial Sequence
  Description of Artificial Sequence: Synthetic oligonucleotide
  Target: FXN; (+) strand; PAM type: YTN; PAM sequence: CTT
tccatgtgactgagtatcca

SEQ ID NO: 32211 - DNA, 20 bp, Artificial Sequence
  Description of Artificial Sequence: Synthetic oligonucleotide
  Target: FXN; (+) strand; PAM type: YTN; PAM sequence: TTT
ccatgtgactgagtatccac

SEQ ID NO: 32212 - DNA, 20 bp, Artificial Sequence
  Description of Artificial Sequence: Synthetic oligonucleotide
  Target: FXN; (+) strand; PAM type: YTN; PAM sequence: TTC
catgtgactgagtatccacc

SEQ ID NO: 32213 - DNA, 20 bp, Artificial Sequence
  Description of Artificial Sequence: Synthetic oligonucleotide
  Target: FXN; (+) strand; PAM type: YTN; PAM sequence: CTG
agtatccaccacattatttt

SEQ ID NO: 32214 - DNA, 20 bp, Artificial Sequence
  Description of Artificial Sequence: Synthetic oligonucleotide
  Target: FXN; (+) strand; PAM type: YTN; PAM sequence: TTA
tttttaatgaaatagtatta

SEQ ID NO: 32215 - DNA, 20 bp, Artificial Sequence
  Description of Artificial Sequence: Synthetic oligonucleotide
  Target: FXN; (+) strand; PAM type: YTN; PAM sequence: TTT
ttaatgaaatagtattagat

SEQ ID NO: 32216 - DNA, 20 bp, Artificial Sequence
  Description of Artificial Sequence: Synthetic oligonucleotide
  Target: FXN; (+) strand; PAM type: YTN; PAM sequence: TTT
taatgaaatagtattagatt

SEQ ID NO: 32217 - DNA, 20 bp, Artificial Sequence
  Description of Artificial Sequence: Synthetic oligonucleotide
  Target: FXN; (+) strand; PAM type: YTN; PAM sequence: TTT
aatgaaatagtattagattg

SEQ ID NO: 32218 - DNA, 20 bp, Artificial Sequence
  Description of Artificial Sequence: Synthetic oligonucleotide
  Target: FXN; (+) strand; PAM type: YTN; PAM sequence: TTA
atgaaatagtattagattgc

SEQ ID NO: 32219 - DNA, 20 bp, Artificial Sequence
  Description of Artificial Sequence: Synthetic oligonucleotide
  Target: FXN; (+) strand; PAM type: YTN; PAM sequence: TTA
gattgcatggatgtgacata

SEQ ID NO: 32220 - DNA, 20 bp, Artificial Sequence
  Description of Artificial Sequence: Synthetic oligonucleotide
  Target: FXN; (+) strand; PAM type: YTN; PAM sequence: TTG
catggatgtgacataatcca

SEQ ID NO: 32221 - DNA, 20 bp, Artificial Sequence
  Description of Artificial Sequence: Synthetic oligonucleotide
  Target: FXN; (+) strand; PAM type: YTN; PAM sequence: TTT
aacccatcccctactgttgg

SEQ ID NO: 32222 - DNA, 20 bp, Artificial Sequence
  Description of Artificial Sequence: Synthetic oligonucleotide
  Target: FXN; (+) strand; PAM type: YTN; PAM sequence: TTA
acccatcccctactgttgga

SEQ ID NO: 32223 - DNA, 20 bp, Artificial Sequence
  Description of Artificial Sequence: Synthetic oligonucleotide
  Target: FXN; (+) strand; PAM type: YTN; PAM sequence: CTA
ctgttggacattcaggttgt

SEQ ID NO: 32224 - DNA, 20 bp, Artificial Sequence
  Description of Artificial Sequence: Synthetic oligonucleotide
  Target: FXN; (+) strand; PAM type: YTN; PAM sequence: CTG
ttggacattcaggttgtttc

SEQ ID NO: 32225 - DNA, 20 bp, Artificial Sequence
  Description of Artificial Sequence: Synthetic oligonucleotide
  Target: FXN; (+) strand; PAM type: YTN; PAM sequence: TTG
gacattcaggttgtttccag

SEQ ID NO: 32226 - DNA, 20 bp, Artificial Sequence
  Description of Artificial Sequence: Synthetic oligonucleotide
  Target: FXN; (+) strand; PAM type: YTN; PAM sequence: TTC
aggttgtttccagagtttca

SEQ ID NO: 32227 - DNA, 20 bp, Artificial Sequence
  Description of Artificial Sequence: Synthetic oligonucleotide
  Target: FXN; (+) strand; PAM type: YTN; PAM sequence: TTG
tttccagagtttcaatatta

SEQ ID NO: 32228 - DNA, 20 bp, Artificial Sequence
  Description of Artificial Sequence: Synthetic oligonucleotide
  Target: FXN; (+) strand; PAM type: YTN; PAM sequence: TTT
ccagagtttcaatattattt

SEQ ID NO: 32229 - DNA, 20 bp, Artificial Sequence
  Description of Artificial Sequence: Synthetic oligonucleotide
  Target: FXN; (+) strand; PAM type: YTN; PAM sequence: TTC
cagagtttcaatattatttt

SEQ ID NO: 32230 - DNA, 20 bp, Artificial Sequence
  Description of Artificial Sequence: Synthetic oligonucleotide
  Target: FXN; (+) strand; PAM type: YTN; PAM sequence: TTT
caatattattttatttaata

SEQ ID NO: 32231 - DNA, 20 bp, Artificial Sequence
  Description of Artificial Sequence: Synthetic oligonucleotide
  Target: FXN; (+) strand; PAM type: YTN; PAM sequence: TTC
aatattattttatttaatac

SEQ ID NO: 32232 - DNA, 20 bp, Artificial Sequence
  Description of Artificial Sequence: Synthetic oligonucleotide
  Target: FXN; (+) strand; PAM type: YTN; PAM sequence: TTA
ttttatttaataccctaata

SEQ ID NO: 32233 - DNA, 20 bp, Artificial Sequence
  Description of Artificial Sequence: Synthetic oligonucleotide
  Target: FXN; (+) strand; PAM type: YTN; PAM sequence: TTT
tatttaataccctaatagtt

SEQ ID NO: 32234 - DNA, 20 bp, Artificial Sequence
  Description of Artificial Sequence: Synthetic oligonucleotide
  Target: FXN; (+) strand; PAM type: YTN; PAM sequence: TTT
atttaataccctaatagtta

SEQ ID NO: 32235 - DNA, 20 bp, Artificial Sequence
  Description of Artificial Sequence: Synthetic oligonucleotide
  Target: FXN; (+) strand; PAM type: YTN; PAM sequence: TTA
tttaataccctaatagttag

SEQ ID NO: 32236 - DNA, 20 bp, Artificial Sequence
  Description of Artificial Sequence: Synthetic oligonucleotide
  Target: FXN; (+) strand; PAM type: YTN; PAM sequence: TTT
aataccctaatagttagagc

SEQ ID NO: 32237 - DNA, 20 bp, Artificial Sequence
  Description of Artificial Sequence: Synthetic oligonucleotide
  Target: FXN; (+) strand; PAM type: YTN; PAM sequence: TTA
ataccctaatagttagagca

SEQ ID NO: 32238 - DNA, 20 bp, Artificial Sequence
  Description of Artificial Sequence: Synthetic oligonucleotide
  Target: FXN; (+) strand; PAM type: YTN; PAM sequence: CTA
atagttagagcaggccatgc

SEQ ID NO: 32239 - DNA, 20 bp, Artificial Sequence
  Description of Artificial Sequence: Synthetic oligonucleotide
  Target: FXN; (+) strand; PAM type: YTN; PAM sequence: TTA
gagcaggccatgctgctatc

SEQ ID NO: 32240 - DNA, 20 bp, Artificial Sequence
  Description of Artificial Sequence: Synthetic oligonucleotide
  Target: FXN; (+) strand; PAM type: YTN; PAM sequence: CTG
ctatcacaaatagacccaaa

SEQ ID NO: 32241 - DNA, 20 bp, Artificial Sequence
  Description of Artificial Sequence: Synthetic oligonucleotide
  Target: FXN; (+) strand; PAM type: YTN; PAM sequence: CTA
tcacaaatagacccaaatat

SEQ ID NO: 32242 - DNA, 20 bp, Artificial Sequence
  Description of Artificial Sequence: Synthetic oligonucleotide
  Target: FXN; (+) strand; PAM type: YTN; PAM sequence: TTT
aatagctcaaaccaataacg

SEQ ID NO: 32243 - DNA, 20 bp, Artificial Sequence
  Description of Artificial Sequence: Synthetic oligonucleotide
  Target: FXN; (+) strand; PAM type: YTN; PAM sequence: TTA
atagctcaaaccaataacgt

SEQ ID NO: 32244 - DNA, 20 bp, Artificial Sequence
  Description of Artificial Sequence: Synthetic oligonucleotide
  Target: FXN; (+) strand; PAM type: YTN; PAM sequence: CTC
aaaccaataacgtttgtgtc

SEQ ID NO: 32245 - DNA, 20 bp, Artificial Sequence
  Description of Artificial Sequence: Synthetic oligonucleotide
  Target: FXN; (+) strand; PAM type: YTN; PAM sequence: TTT
gtgtcctcctctctgggcag

SEQ ID NO: 32246 - DNA, 20 bp, Artificial Sequence
  Description of Artificial Sequence: Synthetic oligonucleotide
  Target: FXN; (+) strand; PAM type: YTN; PAM sequence: TTG
tgtcctcctctctgggcagt

SEQ ID NO: 32247 - DNA, 20 bp, Artificial Sequence
  Description of Artificial Sequence: Synthetic oligonucleotide
  Target: FXN; (+) strand; PAM type: YTN; PAM sequence: CTC
ctctctgggcagtacagggt

SEQ ID NO: 32248 - DNA, 20 bp, Artificial Sequence
  Description of Artificial Sequence: Synthetic oligonucleotide
  Target: FXN; (+) strand; PAM type: YTN; PAM sequence: CTC
tctgggcagtacagggttgg

SEQ ID NO: 32249 - DNA, 20 bp, Artificial Sequence
  Description of Artificial Sequence: Synthetic oligonucleotide
  Target: FXN; (+) strand; PAM type: YTN; PAM sequence: CTC
tgggcagtacagggttggca

SEQ ID NO: 32250 - DNA, 20 bp, Artificial Sequence
  Description of Artificial Sequence: Synthetic oligonucleotide
  Target: FXN; (+) strand; PAM type: YTN; PAM sequence: CTG
ggcagtacagggttggcata

SEQ ID NO: 32251 - DNA, 20 bp, Artificial Sequence
  Description of Artificial Sequence: Synthetic oligonucleotide
  Target: FXN; (+) strand; PAM type: YTN; PAM sequence: TTG
gcatacctcctgaagtgaat

SEQ ID NO: 32252 - DNA, 20 bp, Artificial Sequence
  Description of Artificial Sequence: Synthetic oligonucleotide
  Target: FXN; (+) strand; PAM type: YTN; PAM sequence: CTC
ctgaagtgaattaggaacta

SEQ ID NO: 32253 - DNA, 20 bp, Artificial Sequence
  Description of Artificial Sequence: Synthetic oligonucleotide
  Target: FXN; (+) strand; PAM type: YTN; PAM sequence: CTG
aagtgaattaggaactacac

SEQ ID NO: 32254 - DNA, 20 bp, Artificial Sequence
  Description of Artificial Sequence: Synthetic oligonucleotide
  Target: FXN; (+) strand; PAM type: YTN; PAM sequence: TTA
ggaactacactcattccagc

SEQ ID NO: 32255 - DNA, 20 bp, Artificial Sequence
  Description of Artificial Sequence: Synthetic oligonucleotide
  Target: FXN; (+) strand; PAM type: YTN; PAM sequence: CTA
cactcattccagcttccagt

SEQ ID NO: 32256 - DNA, 20 bp, Artificial Sequence
  Description of Artificial Sequence: Synthetic oligonucleotide
  Target: FXN; (+) strand; PAM type: YTN; PAM sequence: CTC
attccagcttccagtttggt

SEQ ID NO: 32257 - DNA, 20 bp, Artificial Sequence
  Description of Artificial Sequence: Synthetic oligonucleotide
  Target: FXN; (+) strand; PAM type: YTN; PAM sequence: TTC
cagcttccagtttggtcttt

SEQ ID NO: 32258 - DNA, 20 bp, Artificial Sequence
  Description of Artificial Sequence: Synthetic oligonucleotide
  Target: FXN; (+) strand; PAM type: YTN; PAM sequence: CTT
ccagtttggtctttatctgt

SEQ ID NO: 32259 - DNA, 20 bp, Artificial Sequence
  Description of Artificial Sequence: Synthetic oligonucleotide
  Target: FXN; (+) strand; PAM type: YTN; PAM sequence: TTC
cagtttggtctttatctgtc

SEQ ID NO: 32260 - DNA, 20 bp, Artificial Sequence
  Description of Artificial Sequence: Synthetic oligonucleotide
  Target: FXN; (+) strand; PAM type: YTN; PAM sequence: TTT
ggtctttatctgtcagtgcc

SEQ ID NO: 32261 - DNA, 20 bp, Artificial Sequence
  Description of Artificial Sequence: Synthetic oligonucleotide
  Target: FXN; (+) strand; PAM type: YTN; PAM sequence: TTG
gtctttatctgtcagtgcct

SEQ ID NO: 32262 - DNA, 20 bp, Artificial Sequence
  Description of Artificial Sequence: Synthetic oligonucleotide
  Target: FXN; (+) strand; PAM type: YTN; PAM sequence: CTT
tatctgtcagtgccttactg

SEQ ID NO: 32263 - DNA, 20 bp, Artificial Sequence
  Description of Artificial Sequence: Synthetic oligonucleotide
  Target: FXN; (+) strand; PAM type: YTN; PAM sequence: TTT
atctgtcagtgccttactgt

SEQ ID NO: 32264 - DNA, 20 bp, Artificial Sequence
  Description of Artificial Sequence: Synthetic oligonucleotide
  Target: FXN; (+) strand; PAM type: YTN; PAM sequence: TTA
tctgtcagtgccttactgtc

SEQ ID NO: 32265 - DNA, 20 bp, Artificial Sequence
  Description of Artificial Sequence: Synthetic oligonucleotide
  Target: FXN; (+) strand; PAM type: YTN; PAM sequence: CTG
tcagtgccttactgtcctct

SEQ ID NO: 32266 - DNA, 20 bp, Artificial Sequence
  Description of Artificial Sequence: Synthetic oligonucleotide
  Target: FXN; (+) strand; PAM type: YTN; PAM sequence: CTT
actgtcctctgcattgttga

SEQ ID NO: 32267 - DNA, 20 bp, Artificial Sequence
  Description of Artificial Sequence: Synthetic oligonucleotide
  Target: FXN; (+) strand; PAM type: YTN; PAM sequence: TTA
ctgtcctctgcattgttgag

SEQ ID NO: 32268 - DNA, 20 bp, Artificial Sequence
  Description of Artificial Sequence: Synthetic oligonucleotide
  Target: FXN; (+) strand; PAM type: YTN; PAM sequence: CTG
tcctctgcattgttgagtct

SEQ ID NO: 32269 - DNA, 20 bp, Artificial Sequence
  Description of Artificial Sequence: Synthetic oligonucleotide
  Target: FXN; (+) strand; PAM type: YTN; PAM sequence: CTC
tgcattgttgagtctcagtc

SEQ ID NO: 32270 - DNA, 20 bp, Artificial Sequence
  Description of Artificial Sequence: Synthetic oligonucleotide
  Target: FXN; (+) strand; PAM type: YTN; PAM sequence: CTG
cattgttgagtctcagtcac

SEQ ID NO: 32271 - DNA, 20 bp, Artificial Sequence
  Description of Artificial Sequence: Synthetic oligonucleotide
  Target: FXN; (+) strand; PAM type: YTN; PAM sequence: TTG
ttgagtctcagtcaccttgt

SEQ ID NO: 32272 - DNA, 20 bp, Artificial Sequence
  Description of Artificial Sequence: Synthetic oligonucleotide
  Target: FXN; (+) strand; PAM type: YTN; PAM sequence: TTG
agtctcagtcaccttgtcca

SEQ ID NO: 32273 - DNA, 20 bp, Artificial Sequence
  Description of Artificial Sequence: Synthetic oligonucleotide
  Target: FXN; (+) strand; PAM type: YTN; PAM sequence: CTC
agtcaccttgtccaagttcc

SEQ ID NO: 32274 - DNA, 20 bp, Artificial Sequence
  Description of Artificial Sequence: Synthetic oligonucleotide
  Target: FXN; (+) strand; PAM type: YTN; PAM sequence: CTT
gtccaagttccattggccag

SEQ ID NO: 32275 - DNA, 20 bp, Artificial Sequence
  Description of Artificial Sequence: Synthetic oligonucleotide
  Target: FXN; (+) strand; PAM type: YTN; PAM sequence: TTG
tccaagttccattggccaga

SEQ ID NO: 32276 - DNA, 20 bp, Artificial Sequence
  Description of Artificial Sequence: Synthetic oligonucleotide
  Target: FXN; (+) strand; PAM type: YTN; PAM sequence: TTC
cattggccagaaagggctag

SEQ ID NO: 32277 - DNA, 20 bp, Artificial Sequence
  Description of Artificial Sequence: Synthetic oligonucleotide
  Target: FXN; (+) strand; PAM type: YTN; PAM sequence: TTG
gccagaaagggctagaagca

SEQ ID NO: 32278 - DNA, 20 bp, Artificial Sequence
  Description of Artificial Sequence: Synthetic oligonucleotide
  Target: FXN; (+) strand; PAM type: YTN; PAM sequence: CTA
gaagcacagaagggctggaa

SEQ ID NO: 32279 - DNA, 20 bp, Artificial Sequence
  Description of Artificial Sequence: Synthetic oligonucleotide
  Target: FXN; (+) strand; PAM type: YTN; PAM sequence: CTG
gaagtggcatttgttcctca

SEQ ID NO: 32280 - DNA, 20 bp, Artificial Sequence
  Description of Artificial Sequence: Synthetic oligonucleotide
  Target: FXN; (+) strand; PAM type: YTN; PAM sequence: TTT
gttcctcactcacattctgg

SEQ ID NO: 32281 - DNA, 20 bp, Artificial Sequence
  Description of Artificial Sequence: Synthetic oligonucleotide
  Target: FXN; (+) strand; PAM type: YTN; PAM sequence: TTG
ttcctcactcacattctggt

SEQ ID NO: 32282 - DNA, 20 bp, Artificial Sequence
  Description of Artificial Sequence: Synthetic oligonucleotide
  Target: FXN; (+) strand; PAM type: YTN; PAM sequence: TTC
ctcactcacattctggtggg

SEQ ID NO: 32283 - DNA, 20 bp, Artificial Sequence
  Description of Artificial Sequence: Synthetic oligonucleotide
  Target: FXN; (+) strand; PAM type: YTN; PAM sequence: CTC
actcacattctggtgggaag

SEQ ID NO: 32284 - DNA, 20 bp, Artificial Sequence
  Description of Artificial Sequence: Synthetic oligonucleotide
  Target: FXN; (+) strand; PAM type: YTN; PAM sequence: CTC
acattctggtgggaagaact

SEQ ID NO: 32285 - DNA, 20 bp, Artificial Sequence
  Description of Artificial Sequence: Synthetic oligonucleotide
  Target: FXN; (+) strand; PAM type: YTN; PAM sequence: TTC
tggtgggaagaacttagtgg

SEQ ID NO: 32286 - DNA, 20 bp, Artificial Sequence
  Description of Artificial Sequence: Synthetic oligonucleotide
  Target: FXN; (+) strand; PAM type: YTN; PAM sequence: CTG
gtgggaagaacttagtggtg

SEQ ID NO: 32287 - DNA, 20 bp, Artificial Sequence
  Description of Artificial Sequence: Synthetic oligonucleotide
  Target: FXN; (+) strand; PAM type: YTN; PAM sequence: CTT
agtggtgtggccttagctga

SEQ ID NO: 32288 - DNA, 20 bp, Artificial Sequence
  Description of Artificial Sequence: Synthetic oligonucleotide
  Target: FXN; (+) strand; PAM type: YTN; PAM sequence: TTA
gtggtgtggccttagctgac

SEQ ID NO: 32289 - DNA, 20 bp, Artificial Sequence
  Description of Artificial Sequence: Synthetic oligonucleotide
  Target: FXN; (+) strand; PAM type: YTN; PAM sequence: CTT
agctgactgtaagggaggct

SEQ ID NO: 32290 - DNA, 20 bp, Artificial Sequence
  Description of Artificial Sequence: Synthetic oligonucleotide
  Target: FXN; (+) strand; PAM type: YTN; PAM sequence: TTA
gctgactgtaagggaggctg

SEQ ID NO: 32291 - DNA, 20 bp, Artificial Sequence
  Description of Artificial Sequence: Synthetic oligonucleotide
  Target: FXN; (+) strand; PAM type: YTN; PAM sequence: CTG
actgtaagggaggctgggaa

SEQ ID NO: 32292 - DNA, 20 bp, Artificial Sequence
  Description of Artificial Sequence: Synthetic oligonucleotide
  Target: FXN; (+) strand; PAM type: YTN; PAM sequence: CTG
taagggaggctgggaaatat

SEQ ID NO: 32293 - DNA, 20 bp, Artificial Sequence
  Description of Artificial Sequence: Synthetic oligonucleotide
  Target: FXN; (+) strand; PAM type: YTN; PAM sequence: CTG
ggaaatatagtctagcgagt

SEQ ID NO: 32294 - DNA, 20 bp, Artificial Sequence
  Description of Artificial Sequence: Synthetic oligonucleotide
  Target: FXN; (+) strand; PAM type: YTN; PAM sequence: CTA
gcgagtgccctggaaaaagc

SEQ ID NO: 32295 - DNA, 20 bp, Artificial Sequence
  Description of Artificial Sequence: Synthetic oligonucleotide
  Target: FXN; (+) strand; PAM type: YTN; PAM sequence: CTG
gaaaaagccggcacggcatt

SEQ ID NO: 32296 - DNA, 20 bp, Artificial Sequence
  Description of Artificial Sequence: Synthetic oligonucleotide
  Target: FXN; (+) strand; PAM type: YTN; PAM sequence: TTC
cccatggaaagctgtcaggc

SEQ ID NO: 32297 - DNA, 20 bp, Artificial Sequence
  Description of Artificial Sequence: Synthetic oligonucleotide
  Target: FXN; (+) strand; PAM type: YTN; PAM sequence: CTG
tcaggcacggctacagtcta

SEQ ID NO: 32298 - DNA, 20 bp, Artificial Sequence
  Description of Artificial Sequence: Synthetic oligonucleotide
  Target: FXN; (+) strand; PAM type: YTN; PAM sequence: CTA
cagtctaccccctgccaacc

SEQ ID NO: 32299 - DNA, 20 bp, Artificial Sequence
  Description of Artificial Sequence: Synthetic oligonucleotide
  Target: FXN; (+) strand; PAM type: YTN; PAM sequence: CTA
ccccctgccaaccagtatct

SEQ ID NO: 32300 - DNA, 20 bp, Artificial Sequence
  Description of Artificial Sequence: Synthetic oligonucleotide
  Target: FXN; (+) strand; PAM type: YTN; PAM sequence: CTG
ccaaccagtatctgcatgga

SEQ ID NO: 32301 - DNA, 20 bp, Artificial Sequence
  Description of Artificial Sequence: Synthetic oligonucleotide
  Target: FXN; (+) strand; PAM type: YTN; PAM sequence: CTG
catggaccctccttccacac

SEQ ID NO: 32302 - DNA, 20 bp, Artificial Sequence
  Description of Artificial Sequence: Synthetic oligonucleotide
  Target: FXN; (+) strand; PAM type: YTN; PAM sequence: CTC
cttccacactcagatgcatt

SEQ ID NO: 32303 - DNA, 20 bp, Artificial Sequence
  Description of Artificial Sequence: Synthetic oligonucleotide
  Target: FXN; (+) strand; PAM type: YTN; PAM sequence: CTT
ccacactcagatgcatttac

SEQ ID NO: 32304 - DNA, 20 bp, Artificial Sequence
  Description of Artificial Sequence: Synthetic oligonucleotide
  Target: FXN; (+) strand; PAM type: YTN; PAM sequence: TTC
cacactcagatgcatttacc

SEQ ID NO: 32305 - DNA, 20 bp, Artificial Sequence
  Description of Artificial Sequence: Synthetic oligonucleotide
  Target: FXN; (+) strand; PAM type: YTN; PAM sequence: CTC
agatgcatttacccccagcc

SEQ ID NO: 32306 - DNA, 20 bp, Artificial Sequence
  Description of Artificial Sequence: Synthetic oligonucleotide
  Target: FXN; (+) strand; PAM type: YTN; PAM sequence: TTT
acccccagccccaagagagc

SEQ ID NO: 32307 - DNA, 20 bp, Artificial Sequence
  Description of Artificial Sequence: Synthetic oligonucleotide
  Target: FXN; (+) strand; PAM type: YTN; PAM sequence: TTA
cccccagccccaagagagcc

SEQ ID NO: 32308 - DNA, 20 bp, Artificial Sequence
  Description of Artificial Sequence: Synthetic oligonucleotide
  Target: FXN; (+) strand; PAM type: YTN; PAM sequence: CTC
cgagtccaagatttccaggt

SEQ ID NO: 32309 - DNA, 20 bp, Artificial Sequence
  Description of Artificial Sequence: Synthetic oligonucleotide
  Target: FXN; (+) strand; PAM type: YTN; PAM sequence: TTT
ccaggtgacatgcagtctcc

SEQ ID NO: 32310 - DNA, 20 bp, Artificial Sequence
  Description of Artificial Sequence: Synthetic oligonucleotide
  Target: FXN; (+) strand; PAM type: YTN; PAM sequence: TTC
caggtgacatgcagtctcct

SEQ ID NO: 32311 - DNA, 20 bp, Artificial Sequence
  Description of Artificial Sequence: Synthetic oligonucleotide
  Target: FXN; (+) strand; PAM type: YTN; PAM sequence: CTC
ctctctcccagctttaggaa

SEQ ID NO: 32312 - DNA, 20 bp, Artificial Sequence
  Description of Artificial Sequence: Synthetic oligonucleotide
  Target: FXN; (+) strand; PAM type: YTN; PAM sequence: CTC
tctcccagctttaggaatgg

SEQ ID NO: 32313 - DNA, 20 bp, Artificial Sequence
  Description of Artificial Sequence: Synthetic oligonucleotide
  Target: FXN; (+) strand; PAM type: YTN; PAM sequence: CTC
tcccagctttaggaatggct

SEQ ID NO: 32314 - DNA, 20 bp, Artificial Sequence
  Description of Artificial Sequence: Synthetic oligonucleotide
  Target: FXN; (+) strand; PAM type: YTN; PAM sequence: CTC
ccagctttaggaatggcttc

SEQ ID NO: 32315 - DNA, 20 bp, Artificial Sequence
  Description of Artificial Sequence: Synthetic oligonucleotide
  Target: FXN; (+) strand; PAM type: YTN; PAM sequence: CTT
taggaatggcttcttctgat

SEQ ID NO: 32316 - DNA, 20 bp, Artificial Sequence
  Description of Artificial Sequence: Synthetic oligonucleotide
  Target: FXN; (+) strand; PAM type: YTN; PAM sequence: TTT
aggaatggcttcttctgatc

SEQ ID NO: 32317 - DNA, 20 bp, Artificial Sequence
  Description of Artificial Sequence: Synthetic oligonucleotide
  Target: FXN; (+) strand; PAM type: YTN; PAM sequence: TTA
ggaatggcttcttctgatct

SEQ ID NO: 32318 - DNA, 20 bp, Artificial Sequence
  Description of Artificial Sequence: Synthetic oligonucleotide
  Target: FXN; (+) strand; PAM type: YTN; PAM sequence: CTT
cttctgatctacacacagac

SEQ ID NO: 32319 - DNA, 20 bp, Artificial Sequence
  Description of Artificial Sequence: Synthetic oligonucleotide
  Target: FXN; (+) strand; PAM type: YTN; PAM sequence: TTC
ttctgatctacacacagaca

SEQ ID NO: 32320 - DNA, 20 bp, Artificial Sequence
  Description of Artificial Sequence: Synthetic oligonucleotide
  Target: FXN; (+) strand; PAM type: YTN; PAM sequence: CTT
ctgatctacacacagacaca

SEQ ID NO: 32321 - DNA, 20 bp, Artificial Sequence
  Description of Artificial Sequence: Synthetic oligonucleotide
  Target: FXN; (+) strand; PAM type: YTN; PAM sequence: TTC
tgatctacacacagacacag

SEQ ID NO: 32322 - DNA, 20 bp, Artificial Sequence
  Description of Artificial Sequence: Synthetic oligonucleotide
  Target: FXN; (+) strand; PAM type: YTN; PAM sequence: CTG
atctacacacagacacagac

SEQ ID NO: 32323 - DNA, 20 bp, Artificial Sequence
  Description of Artificial Sequence: Synthetic oligonucleotide
  Target: FXN; (+) strand; PAM type: YTN; PAM sequence: CTA
cacacagacacagacacaca

SEQ ID NO: 32324 - DNA, 20 bp, Artificial Sequence
  Description of Artificial Sequence: Synthetic oligonucleotide
  Target: FXN; (+) strand; PAM type: YTN; PAM sequence: CTG
caactgtaactccattcaga

SEQ ID NO: 32325 - DNA, 20 bp, Artificial Sequence
  Description of Artificial Sequence: Synthetic oligonucleotide
  Target: FXN; (+) strand; PAM type: YTN; PAM sequence: CTG
taactccattcagaaaagag

SEQ ID NO: 32326 - DNA, 20 bp, Artificial Sequence
  Description of Artificial Sequence: Synthetic oligonucleotide
  Target: FXN; (+) strand; PAM type: YTN; PAM sequence: CTC
cattcagaaaagaggcacag

SEQ ID NO: 32327 - DNA, 20 bp, Artificial Sequence
  Description of Artificial Sequence: Synthetic oligonucleotide
  Target: FXN; (+) strand; PAM type: YTN; PAM sequence: TTC
agaaaagaggcacagcacta

SEQ ID NO: 32328 - DNA, 20 bp, Artificial Sequence
  Description of Artificial Sequence: Synthetic oligonucleotide
  Target: FXN; (+) strand; PAM type: YTN; PAM sequence: CTA
gctgcccgcagcactggagc

SEQ ID NO: 32329 - DNA, 20 bp, Artificial Sequence
  Description of Artificial Sequence: Synthetic oligonucleotide
  Target: FXN; (+) strand; PAM type: YTN; PAM sequence: CTG
cccgcagcactggagccctg

SEQ ID NO: 32330 - DNA, 20 bp, Artificial Sequence
  Description of Artificial Sequence: Synthetic oligonucleotide
  Target: FXN; (+) strand; PAM type: YTN; PAM sequence: CTG
gagccctgctgggcagcact

SEQ ID NO: 32331 - DNA, 20 bp, Artificial Sequence
  Description of Artificial Sequence: Synthetic oligonucleotide
  Target: FXN; (+) strand; PAM type: YTN; PAM sequence: CTG
ctgggcagcactggatcaac

SEQ ID NO: 32332 - DNA, 20 bp, Artificial Sequence
  Description of Artificial Sequence: Synthetic oligonucleotide
  Target: FXN; (+) strand; PAM type: YTN; PAM sequence: CTG
ggcagcactggatcaacctc

SEQ ID NO: 32333 - DNA, 20 bp, Artificial Sequence
  Description of Artificial Sequence: Synthetic oligonucleotide
  Target: FXN; (+) strand; PAM type: YTN; PAM sequence: CTG
gatcaacctctgccctggca

SEQ ID NO: 32334 - DNA, 20 bp, Artificial Sequence
  Description of Artificial Sequence: Synthetic oligonucleotide
  Target: FXN; (+) strand; PAM type: YTN; PAM sequence: CTC
tgccctggcagaggagcatg

SEQ ID NO: 32335 - DNA, 20 bp, Artificial Sequence
  Description of Artificial Sequence: Synthetic oligonucleotide
  Target: FXN; (+) strand; PAM type: YTN; PAM sequence: CTG
ccctggcagaggagcatgtt

SEQ ID NO: 32336 - DNA, 20 bp, Artificial Sequence
  Description of Artificial Sequence: Synthetic oligonucleotide
  Target: FXN; (+) strand; PAM type: YTN; PAM sequence: CTG
gcagaggagcatgttcctcc

SEQ ID NO: 32337 - DNA, 20 bp, Artificial Sequence
  Description of Artificial Sequence: Synthetic oligonucleotide
  Target: FXN; (+) strand; PAM type: YTN; PAM sequence: TTC
ctccacaaatccctgcttca

SEQ ID NO: 32338 - DNA, 20 bp, Artificial Sequence
  Description of Artificial Sequence: Synthetic oligonucleotide
  Target: FXN; (+) strand; PAM type: YTN; PAM sequence: CTC
cacaaatccctgcttcagcc

SEQ ID NO: 32339 - DNA, 20 bp, Artificial Sequence
  Description of Artificial Sequence: Synthetic oligonucleotide
  Target: FXN; (+) strand; PAM type: YTN; PAM sequence: CTG
cttcagcctctcgagaggct

SEQ ID NO: 32340 - DNA, 20 bp, Artificial Sequence
  Description of Artificial Sequence: Synthetic oligonucleotide
  Target: FXN; (+) strand; PAM type: YTN; PAM sequence: CTT
cagcctctcgagaggctcct

SEQ ID NO: 32341 - DNA, 20 bp, Artificial Sequence
  Description of Artificial Sequence: Synthetic oligonucleotide
  Target: FXN; (+) strand; PAM type: YTN; PAM sequence: TTC
agcctctcgagaggctcctc

SEQ ID NO: 32342 - DNA, 20 bp, Artificial Sequence
  Description of Artificial Sequence: Synthetic oligonucleotide
  Target: FXN; (+) strand; PAM type: YTN; PAM sequence: CTC
tcgagaggctcctccttgtc

SEQ ID NO: 32343 - DNA, 20 bp, Artificial Sequence
  Description of Artificial Sequence: Synthetic oligonucleotide
  Target: FXN; (+) strand; PAM type: YTN; PAM sequence: CTC
gagaggctcctccttgtctg

SEQ ID NO: 32344 - DNA, 20 bp, Artificial Sequence
  Description of Artificial Sequence: Synthetic oligonucleotide
  Target: FXN; (+) strand; PAM type: YTN; PAM sequence: CTC
ctccttgtctgttattttcc

SEQ ID NO: 32345 - DNA, 20 bp, Artificial Sequence
  Description of Artificial Sequence: Synthetic oligonucleotide
  Target: FXN; (+) strand; PAM type: YTN; PAM sequence: CTC
cttgtctgttattttccttg

SEQ ID NO: 32346 - DNA, 20 bp, Artificial Sequence
  Description of Artificial Sequence: Synthetic oligonucleotide
  Target: FXN; (+) strand; PAM type: YTN; PAM sequence: CTT
gtctgttattttccttggcc

SEQ ID NO: 32347 - DNA, 20 bp, Artificial Sequence
  Description of Artificial Sequence: Synthetic oligonucleotide
  Target: FXN; (+) strand; PAM type: YTN; PAM sequence: TTG
tctgttattttccttggcca

SEQ ID NO: 32348 - DNA, 20 bp, Artificial Sequence
  Description of Artificial Sequence: Synthetic oligonucleotide
  Target: FXN; (+) strand; PAM type: YTN; PAM sequence: CTG
ttattttccttggccacaag

SEQ ID NO: 32349 - DNA, 20 bp, Artificial Sequence
  Description of Artificial Sequence: Synthetic oligonucleotide
  Target: FXN; (+) strand; PAM type: YTN; PAM sequence: TTA
ttttccttggccacaaggca

SEQ ID NO: 32350 - DNA, 20 bp, Artificial Sequence
  Description of Artificial Sequence: Synthetic oligonucleotide
  Target: FXN; (+) strand; PAM type: YTN; PAM sequence: TTT
tccttggccacaaggcaggc

SEQ ID NO: 32351 - DNA, 20 bp, Artificial Sequence
  Description of Artificial Sequence: Synthetic oligonucleotide
  Target: FXN; (+) strand; PAM type: YTN; PAM sequence: TTT
ccttggccacaaggcaggca

SEQ ID NO: 32352 - DNA, 20 bp, Artificial Sequence
  Description of Artificial Sequence: Synthetic oligonucleotide
  Target: FXN; (+) strand; PAM type: YTN; PAM sequence: TTC
cttggccacaaggcaggcag

SEQ ID NO: 32353 - DNA, 20 bp, Artificial Sequence
  Description of Artificial Sequence: Synthetic oligonucleotide
  Target: FXN; (+) strand; PAM type: YTN; PAM sequence: CTT
ggccacaaggcaggcaggca

SEQ ID NO: 32354 - DNA, 20 bp, Artificial Sequence
  Description of Artificial Sequence: Synthetic oligonucleotide
  Target: FXN; (+) strand; PAM type: YTN; PAM sequence: TTG
gccacaaggcaggcaggcag

SEQ ID NO: 32355 - DNA, 20 bp, Artificial Sequence
  Description of Artificial Sequence: Synthetic oligonucleotide
  Target: FXN; (+) strand; PAM type: YTN; PAM sequence: CTC
ctccggggcaaggagccttc

SEQ ID NO: 32356 - DNA, 20 bp, Artificial Sequence
  Description of Artificial Sequence: Synthetic oligonucleotide
  Target: FXN; (+) strand; PAM type: YTN; PAM sequence: CTC
cggggcaaggagccttcaca

SEQ ID NO: 32357 - DNA, 20 bp, Artificial Sequence
  Description of Artificial Sequence: Synthetic oligonucleotide
  Target: FXN; (+) strand; PAM type: YTN; PAM sequence: CTT
cacagcccacttcctgctaa

SEQ ID NO: 32358 - DNA, 20 bp, Artificial Sequence
  Description of Artificial Sequence: Synthetic oligonucleotide
  Target: FXN; (+) strand; PAM type: YTN; PAM sequence: TTC
acagcccacttcctgctaat

SEQ ID NO: 32359 - DNA, 20 bp, Artificial Sequence
  Description of Artificial Sequence: Synthetic oligonucleotide
  Target: FXN; (+) strand; PAM type: YTN; PAM sequence: CTT
cctgctaataacagtttggg

SEQ ID NO: 32360 - DNA, 20 bp, Artificial Sequence
  Description of Artificial Sequence: Synthetic oligonucleotide
  Target: FXN; (+) strand; PAM type: YTN; PAM sequence: TTC
ctgctaataacagtttgggg

SEQ ID NO: 32361 - DNA, 20 bp, Artificial Sequence
  Description of Artificial Sequence: Synthetic oligonucleotide
  Target: FXN; (+) strand; PAM type: YTN; PAM sequence: CTG
ctaataacagtttggggttc

SEQ ID NO: 32362 - DNA, 20 bp, Artificial Sequence
  Description of Artificial Sequence: Synthetic oligonucleotide
  Target: FXN; (+) strand; PAM type: YTN; PAM sequence: CTA
ataacagtttggggttccac

SEQ ID NO: 32363 - DNA, 20 bp, Artificial Sequence
  Description of Artificial Sequence: Synthetic oligonucleotide
  Target: FXN; (+) strand; PAM type: YTN; PAM sequence: TTT
ggggttccacagggtgtttt

SEQ ID NO: 32364 - DNA, 20 bp, Artificial Sequence
  Description of Artificial Sequence: Synthetic oligonucleotide
  Target: FXN; (+) strand; PAM type: YTN; PAM sequence: TTG
gggttccacagggtgtttta

SEQ ID NO: 32365 - DNA, 20 bp, Artificial Sequence
  Description of Artificial Sequence: Synthetic oligonucleotide
  Target: FXN; (+) strand; PAM type: YTN; PAM sequence: TTC
cacagggtgttttaagactc

SEQ ID NO: 32366 - DNA, 20 bp, Artificial Sequence
  Description of Artificial Sequence: Synthetic oligonucleotide
  Target: FXN; (+) strand; PAM type: YTN; PAM sequence: TTT
taagactccagtcagctatt

SEQ ID NO: 32367 - DNA, 20 bp, Artificial Sequence
  Description of Artificial Sequence: Synthetic oligonucleotide
  Target: FXN; (+) strand; PAM type: YTN; PAM sequence: TTT
aagactccagtcagctattt

SEQ ID NO: 32368 - DNA, 20 bp, Artificial Sequence
  Description of Artificial Sequence: Synthetic oligonucleotide
  Target: FXN; (+) strand; PAM type: YTN; PAM sequence: TTA
agactccagtcagctatttt

SEQ ID NO: 32369 - DNA, 20 bp, Artificial Sequence
  Description of Artificial Sequence: Synthetic oligonucleotide
  Target: FXN; (+) strand; PAM type: YTN; PAM sequence: CTC
cagtcagctattttaggcca

SEQ ID NO: 32370 - DNA, 20 bp, Artificial Sequence
  Description of Artificial Sequence: Synthetic oligonucleotide
  Target: FXN; (+) strand; PAM type: YTN; PAM sequence: CTA
ttttaggccagactcatttc

SEQ ID NO: 32371 - DNA, 20 bp, Artificial Sequence
  Description of Artificial Sequence: Synthetic oligonucleotide
  Target: FXN; (+) strand; PAM type: YTN; PAM sequence: TTT
taggccagactcatttctct

SEQ ID NO: 32372 - DNA, 20 bp, Artificial Sequence
  Description of Artificial Sequence: Synthetic oligonucleotide
  Target: FXN; (+) strand; PAM type: YTN; PAM sequence: TTT
aggccagactcatttctctc

SEQ ID NO: 32373 - DNA, 20 bp, Artificial Sequence
  Description of Artificial Sequence: Synthetic oligonucleotide
  Target: FXN; (+) strand; PAM type: YTN; PAM sequence: TTA
ggccagactcatttctctct

SEQ ID NO: 32374 - DNA, 20 bp, Artificial Sequence
  Description of Artificial Sequence: Synthetic oligonucleotide
  Target: FXN; (+) strand; PAM type: YTN; PAM sequence: CTC
atttctctctctctctctct

SEQ ID NO: 32375 - DNA, 20 bp, Artificial Sequence
  Description of Artificial Sequence: Synthetic oligonucleotide
  Target: FXN; (+) strand; PAM type: YTN; PAM sequence: TTT
ctctctctctctctcttttt

SEQ ID NO: 32376 - DNA, 20 bp, Artificial Sequence
  Description of Artificial Sequence: Synthetic oligonucleotide
  Target: FXN; (+) strand; PAM type: YTN; PAM sequence: TTC
tctctctctctctctttttt

SEQ ID NO: 32377 - DNA, 20 bp, Artificial Sequence
  Description of Artificial Sequence: Synthetic oligonucleotide
  Target: FXN; (+) strand; PAM type: YTN; PAM sequence: CTC
tctctctctctctttttttt

SEQ ID NO: 32378 - DNA, 20 bp, Artificial Sequence
  Description of Artificial Sequence: Synthetic oligonucleotide
  Target: FXN; (+) strand; PAM type: YTN; PAM sequence: CTC
tctctctctctttttttttc

SEQ ID NO: 32379 - DNA, 20 bp, Artificial Sequence
  Description of Artificial Sequence: Synthetic oligonucleotide
  Target: FXN; (+) strand; PAM type: YTN; PAM sequence: CTC
tctctctctttttttttctt

SEQ ID NO: 32380 - DNA, 20 bp, Artificial Sequence
  Description of Artificial Sequence: Synthetic oligonucleotide
  Target: FXN; (+) strand; PAM type: YTN; PAM sequence: CTC
tctctctttttttttctttt

SEQ ID NO: 32381 - DNA, 20 bp, Artificial Sequence
  Description of Artificial Sequence: Synthetic oligonucleotide
  Target: FXN; (+) strand; PAM type: YTN; PAM sequence: CTC
tctctttttttttcttttat

SEQ ID NO: 32382 - DNA, 20 bp, Artificial Sequence
  Description of Artificial Sequence: Synthetic oligonucleotide
  Target: FXN; (+) strand; PAM type: YTN; PAM sequence: CTC
tctttttttttcttttatga

SEQ ID NO: 32383 - DNA, 20 bp, Artificial Sequence
  Description of Artificial Sequence: Synthetic oligonucleotide
  Target: FXN; (+) strand; PAM type: YTN; PAM sequence: CTC
tttttttttcttttatgaaa

SEQ ID NO: 32384 - DNA, 20 bp, Artificial Sequence
  Description of Artificial Sequence: Synthetic oligonucleotide
  Target: FXN; (+) strand; PAM type: YTN; PAM sequence: CTT
tttttttcttttatgaaatc

SEQ ID NO: 32385 - DNA, 20 bp, Artificial Sequence
  Description of Artificial Sequence: Synthetic oligonucleotide
  Target: FXN; (+) strand; PAM type: YTN; PAM sequence: TTT
ttttttcttttatgaaatca

SEQ ID NO: 32386 - DNA, 20 bp, Artificial Sequence
  Description of Artificial Sequence: Synthetic oligonucleotide
  Target: FXN; (+) strand; PAM type: YTN; PAM sequence: TTT
tttttcttttatgaaatcac

SEQ ID NO: 32387 - DNA, 20 bp, Artificial Sequence
  Description of Artificial Sequence: Synthetic oligonucleotide
  Target: FXN; (+) strand; PAM type: YTN; PAM sequence: TTT
ttttcttttatgaaatcaca

SEQ ID NO: 32388 - DNA, 20 bp, Artificial Sequence
  Description of Artificial Sequence: Synthetic oligonucleotide
  Target: FXN; (+) strand; PAM type: YTN; PAM sequence: TTT
tttcttttatgaaatcacac

SEQ ID NO: 32389 - DNA, 20 bp, Artificial Sequence
  Description of Artificial Sequence: Synthetic oligonucleotide
  Target: FXN; (+) strand; PAM type: YTN; PAM sequence: TTT
ttcttttatgaaatcacacc

SEQ ID NO: 32390 - DNA, 20 bp, Artificial Sequence
  Description of Artificial Sequence: Synthetic oligonucleotide
  Target: FXN; (+) strand; PAM type: YTN; PAM sequence: TTT
tcttttatgaaatcacaccc

SEQ ID NO: 32391 - DNA, 20 bp, Artificial Sequence
  Description of Artificial Sequence: Synthetic oligonucleotide
  Target: FXN; (+) strand; PAM type: YTN; PAM sequence: TTT
cttttatgaaatcacaccct

SEQ ID NO: 32392 - DNA, 20 bp, Artificial Sequence
  Description of Artificial Sequence: Synthetic oligonucleotide
  Target: FXN; (+) strand; PAM type: YTN; PAM sequence: TTC
ttttatgaaatcacaccctg

SEQ ID NO: 32393 - DNA, 20 bp, Artificial Sequence
  Description of Artificial Sequence: Synthetic oligonucleotide
  Target: FXN; (+) strand; PAM type: YTN; PAM sequence: CTT
ttatgaaatcacaccctgag

SEQ ID NO: 32394 - DNA, 20 bp, Artificial Sequence
  Description of Artificial Sequence: Synthetic oligonucleotide
  Target: FXN; (+) strand; PAM type: YTN; PAM sequence: TTT
tatgaaatcacaccctgaga

SEQ ID NO: 32395 - DNA, 20 bp, Artificial Sequence
  Description of Artificial Sequence: Synthetic oligonucleotide
  Target: FXN; (+) strand; PAM type: YTN; PAM sequence: TTT
atgaaatcacaccctgagac

SEQ ID NO: 32396 - DNA, 20 bp, Artificial Sequence
  Description of Artificial Sequence: Synthetic oligonucleotide
  Target: FXN; (+) strand; PAM type: YTN; PAM sequence: TTA
tgaaatcacaccctgagacc

SEQ ID NO: 32397 - DNA, 20 bp, Artificial Sequence
  Description of Artificial Sequence: Synthetic oligonucleotide
  Target: FXN; (+) strand; PAM type: YTN; PAM sequence: CTG
agacccaggctggagtgcag

SEQ ID NO: 32398 - DNA, 20 bp, Artificial Sequence
  Description of Artificial Sequence: Synthetic oligonucleotide
  Target: FXN; (+) strand; PAM type: YTN; PAM sequence: CTG
gagtgcagtggtgcgatctc

SEQ ID NO: 32399 - DNA, 20 bp, Artificial Sequence
  Description of Artificial Sequence: Synthetic oligonucleotide
  Target: FXN; (+) strand; PAM type: YTN; PAM sequence: CTC
ggctcactgcagcctccgcc

SEQ ID NO: 32400 - DNA, 20 bp, Artificial Sequence
  Description of Artificial Sequence: Synthetic oligonucleotide
  Target: FXN; (+) strand; PAM type: YTN; PAM sequence: CTC
actgcagcctccgcctcccg

SEQ ID NO: 32401 - DNA, 20 bp, Artificial Sequence
  Description of Artificial Sequence: Synthetic oligonucleotide
  Target: FXN; (+) strand; PAM type: YTN; PAM sequence: CTG
cagcctccgcctcccgggtt

SEQ ID NO: 32402 - DNA, 20 bp, Artificial Sequence
  Description of Artificial Sequence: Synthetic oligonucleotide
  Target: FXN; (+) strand; PAM type: YTN; PAM sequence: CTC
cgcctcccgggttcaagcaa

SEQ ID NO: 32403 - DNA, 20 bp, Artificial Sequence
  Description of Artificial Sequence: Synthetic oligonucleotide
  Target: FXN; (+) strand; PAM type: YTN; PAM sequence: CTC
ccgggttcaagcaatcctcc

SEQ ID NO: 32404 - DNA, 20 bp, Artificial Sequence
  Description of Artificial Sequence: Synthetic oligonucleotide
  Target: FXN; (+) strand; PAM type: YTN; PAM sequence: TTC
aagcaatcctcctgcctcag

SEQ ID NO: 32405 - DNA, 20 bp, Artificial Sequence
  Description of Artificial Sequence: Synthetic oligonucleotide
  Target: FXN; (+) strand; PAM type: YTN; PAM sequence: CTC
ctgcctcagcctcctgagta

SEQ ID NO: 32406 - DNA, 20 bp, Artificial Sequence
  Description of Artificial Sequence: Synthetic oligonucleotide
  Target: FXN; (+) strand; PAM type: YTN; PAM sequence: CTG
cctcagcctcctgagtagct

SEQ ID NO: 32407 - DNA, 20 bp, Artificial Sequence
  Description of Artificial Sequence: Synthetic oligonucleotide
  Target: FXN; (+) strand; PAM type: YTN; PAM sequence: CTC
agcctcctgagtagctggga

SEQ ID NO: 32408 - DNA, 20 bp, Artificial Sequence
  Description of Artificial Sequence: Synthetic oligonucleotide
  Target: FXN; (+) strand; PAM type: YTN; PAM sequence: CTC
ctgagtagctgggactatag

SEQ ID NO: 32409 - DNA, 20 bp, Artificial Sequence
  Description of Artificial Sequence: Synthetic oligonucleotide
  Target: FXN; (+) strand; PAM type: YTN; PAM sequence: CTG
agtagctgggactataggcg

SEQ ID NO: 32410 - DNA, 20 bp, Artificial Sequence
  Description of Artificial Sequence: Synthetic oligonucleotide
  Target: FXN; (+) strand; PAM type: YTN; PAM sequence: CTG
ggactataggcgtgcagtgc

SEQ ID NO: 32411 - DNA, 20 bp, Artificial Sequence
  Description of Artificial Sequence: Synthetic oligonucleotide
  Target: FXN; (+) strand; PAM type: YTN; PAM sequence: CTA
taggcgtgcagtgccacacc

SEQ ID NO: 32412 - DNA, 20 bp, Artificial Sequence
  Description of Artificial Sequence: Synthetic oligonucleotide
  Target: FXN; (+) strand; PAM type: YTN; PAM sequence: CTA
gctaatttttgtatttttag

SEQ ID NO: 32413 - DNA, 20 bp, Artificial Sequence
  Description of Artificial Sequence: Synthetic oligonucleotide
  Target: FXN; (+) strand; PAM type: YTN; PAM sequence: CTA
atttttgtatttttagtaaa

SEQ ID NO: 32414 - DNA, 20 bp, Artificial Sequence
  Description of Artificial Sequence: Synthetic oligonucleotide
  Target: FXN; (+) strand; PAM type: YTN; PAM sequence: TTT
ttgtatttttagtaaagacg

SEQ ID NO: 32415 - DNA, 20 bp, Artificial Sequence
  Description of Artificial Sequence: Synthetic oligonucleotide
  Target: FXN; (+) strand; PAM type: YTN; PAM sequence: TTT
tgtatttttagtaaagacgg

SEQ ID NO: 32416 - DNA, 20 bp, Artificial Sequence
  Description of Artificial Sequence: Synthetic oligonucleotide
  Target: FXN; (+) strand; PAM type: YTN; PAM sequence: TTT
gtatttttagtaaagacggg

SEQ ID NO: 32417 - DNA, 20 bp, Artificial Sequence
  Description of Artificial Sequence: Synthetic oligonucleotide
  Target: FXN; (+) strand; PAM type: YTN; PAM sequence: TTG
tatttttagtaaagacgggg

SEQ ID NO: 32418 - DNA, 20 bp, Artificial Sequence
  Description of Artificial Sequence: Synthetic oligonucleotide
  Target: FXN; (+) strand; PAM type: YTN; PAM sequence: TTT
ttagtaaagacggggtttca

SEQ ID NO: 32419 - DNA, 20 bp, Artificial Sequence
  Description of Artificial Sequence: Synthetic oligonucleotide
  Target: FXN; (+) strand; PAM type: YTN; PAM sequence: TTT
tagtaaagacggggtttcac

SEQ ID NO: 32420 - DNA, 20 bp, Artificial Sequence
  Description of Artificial Sequence: Synthetic oligonucleotide
  Target: FXN; (+) strand; PAM type: YTN; PAM sequence: TTT
agtaaagacggggtttcacc

SEQ ID NO: 32421 - DNA, 20 bp, Artificial Sequence
  Description of Artificial Sequence: Synthetic oligonucleotide
  Target: FXN; (+) strand; PAM type: YTN; PAM sequence: TTA
gtaaagacggggtttcacca

SEQ ID NO: 32422 - DNA, 20 bp, Artificial Sequence
  Description of Artificial Sequence: Synthetic oligonucleotide
  Target: FXN; (+) strand; PAM type: YTN; PAM sequence: TTT
caccatgttggccaggctgg

SEQ ID NO: 32423 - DNA, 20 bp, Artificial Sequence
  Description of Artificial Sequence: Synthetic oligonucleotide
  Target: FXN; (+) strand; PAM type: YTN; PAM sequence: TTC
accatgttggccaggctggt

SEQ ID NO: 32424 - DNA, 20 bp, Artificial Sequence
  Description of Artificial Sequence: Synthetic oligonucleotide
  Target: FXN; (+) strand; PAM type: YTN; PAM sequence: TTG
gccaggctggtcttgaactc

SEQ ID NO: 32425 - DNA, 20 bp, Artificial Sequence
  Description of Artificial Sequence: Synthetic oligonucleotide
  Target: FXN; (+) strand; PAM type: YTN; PAM sequence: CTG
gtcttgaactcctgacctca

SEQ ID NO: 32426 - DNA, 20 bp, Artificial Sequence
  Description of Artificial Sequence: Synthetic oligonucleotide
  Target: FXN; (+) strand; PAM type: YTN; PAM sequence: CTT
gaactcctgacctcagatga

SEQ ID NO: 32427 - DNA, 20 bp, Artificial Sequence
  Description of Artificial Sequence: Synthetic oligonucleotide
  Target: FXN; (+) strand; PAM type: YTN; PAM sequence: TTG
aactcctgacctcagatgat

SEQ ID NO: 32428 - DNA, 20 bp, Artificial Sequence
  Description of Artificial Sequence: Synthetic oligonucleotide
  Target: FXN; (+) strand; PAM type: YTN; PAM sequence: CTC
ctgacctcagatgatccgcc

SEQ ID NO: 32429 - DNA, 20 bp, Artificial Sequence
  Description of Artificial Sequence: Synthetic oligonucleotide
  Target: FXN; (+) strand; PAM type: YTN; PAM sequence: CTG
acctcagatgatccgcccgc

SEQ ID NO: 32430 - DNA, 20 bp, Artificial Sequence
  Description of Artificial Sequence: Synthetic oligonucleotide
  Target: FXN; (+) strand; PAM type: YTN; PAM sequence: CTC
agatgatccgcccgcctcgg

SEQ ID NO: 32431 - DNA, 20 bp, Artificial Sequence
  Description of Artificial Sequence: Synthetic oligonucleotide
  Target: FXN; (+) strand; PAM type: YTN; PAM sequence: CTC
ggcctcccaaagtgctggga

SEQ ID NO: 32432 - DNA, 20 bp, Artificial Sequence
  Description of Artificial Sequence: Synthetic oligonucleotide
  Target: FXN; (+) strand; PAM type: YTN; PAM sequence: CTC
ccaaagtgctgggattactg

SEQ ID NO: 32433 - DNA, 20 bp, Artificial Sequence
  Description of Artificial Sequence: Synthetic oligonucleotide
  Target: FXN; (+) strand; PAM type: YTN; PAM sequence: CTG
ggattactggcatgagccac

SEQ ID NO: 32434 - DNA, 20 bp, Artificial Sequence
  Description of Artificial Sequence: Synthetic oligonucleotide
  Target: FXN; (+) strand; PAM type: YTN; PAM sequence: TTA
ctggcatgagccactgcgcc

SEQ ID NO: 32435 - DNA, 20 bp, Artificial Sequence
  Description of Artificial Sequence: Synthetic oligonucleotide
  Target: FXN; (+) strand; PAM type: YTN; PAM sequence: CTG
gcatgagccactgcgcccag

SEQ ID NO: 32436 - DNA, 20 bp, Artificial Sequence
  Description of Artificial Sequence: Synthetic oligonucleotide
  Target: FXN; (+) strand; PAM type: YTN; PAM sequence: CTG
cgcccagcccagactcattt

SEQ ID NO: 32437 - DNA, 20 bp, Artificial Sequence
  Description of Artificial Sequence: Synthetic oligonucleotide
  Target: FXN; (+) strand; PAM type: YTN; PAM sequence: CTC
atttttctttgagagtaggc

SEQ ID NO: 32438 - DNA, 20 bp, Artificial Sequence
  Description of Artificial Sequence: Synthetic oligonucleotide
  Target: FXN; (+) strand; PAM type: YTN; PAM sequence: TTT
ttctttgagagtaggctttt

SEQ ID NO: 32439 - DNA, 20 bp, Artificial Sequence
  Description of Artificial Sequence: Synthetic oligonucleotide
  Target: FXN; (+) strand; PAM type: YTN; PAM sequence: TTT
tctttgagagtaggcttttc

SEQ ID NO: 32440 - DNA, 20 bp, Artificial Sequence
  Description of Artificial Sequence: Synthetic oligonucleotide
  Target: FXN; (+) strand; PAM type: YTN; PAM sequence: TTT
ctttgagagtaggcttttcc

SEQ ID NO: 32441 - DNA, 20 bp, Artificial Sequence
  Description of Artificial Sequence: Synthetic oligonucleotide
  Target: FXN; (+) strand; PAM type: YTN; PAM sequence: TTC
tttgagagtaggcttttccc

SEQ ID NO: 32442 - DNA, 20 bp, Artificial Sequence
  Description of Artificial Sequence: Synthetic oligonucleotide
  Target: FXN; (+) strand; PAM type: YTN; PAM sequence: CTT
tgagagtaggcttttcccaa

SEQ ID NO: 32443 - DNA, 20 bp, Artificial Sequence
  Description of Artificial Sequence: Synthetic oligonucleotide
  Target: FXN; (+) strand; PAM type: YTN; PAM sequence: TTT
gagagtaggcttttcccaaa

SEQ ID NO: 32444 - DNA, 20 bp, Artificial Sequence
  Description of Artificial Sequence: Synthetic oligonucleotide
  Target: FXN; (+) strand; PAM type: YTN; PAM sequence: TTG
agagtaggcttttcccaaaa

SEQ ID NO: 32445 - DNA, 20 bp, Artificial Sequence
  Description of Artificial Sequence: Synthetic oligonucleotide
  Target: FXN; (+) strand; PAM type: YTN; PAM sequence: CTT
ttcccaaaagtaggcttctg

SEQ ID NO: 32446 - DNA, 20 bp, Artificial Sequence
  Description of Artificial Sequence: Synthetic oligonucleotide
  Target: FXN; (+) strand; PAM type: YTN; PAM sequence: TTT
tcccaaaagtaggcttctga

SEQ ID NO: 32447 - DNA, 20 bp, Artificial Sequence
  Description of Artificial Sequence: Synthetic oligonucleotide
  Target: FXN; (+) strand; PAM type: YTN; PAM sequence: TTT
cccaaaagtaggcttctgag

SEQ ID NO: 32448 - DNA, 20 bp, Artificial Sequence
  Description of Artificial Sequence: Synthetic oligonucleotide
  Target: FXN; (+) strand; PAM type: YTN; PAM sequence: TTC
ccaaaagtaggcttctgagc

SEQ ID NO: 32449 - DNA, 20 bp, Artificial Sequence
  Description of Artificial Sequence: Synthetic oligonucleotide
  Target: FXN; (+) strand; PAM type: YTN; PAM sequence: CTT
ctgagctattcactttcagg

SEQ ID NO: 32450 - DNA, 20 bp, Artificial Sequence
  Description of Artificial Sequence: Synthetic oligonucleotide
  Target: FXN; (+) strand; PAM type: YTN; PAM sequence: TTC
tgagctattcactttcaggc

SEQ ID NO: 32451 - DNA, 20 bp, Artificial Sequence
  Description of Artificial Sequence: Synthetic oligonucleotide
  Target: FXN; (+) strand; PAM type: YTN; PAM sequence: CTG
agctattcactttcaggcag

SEQ ID NO: 32452 - DNA, 20 bp, Artificial Sequence
  Description of Artificial Sequence: Synthetic oligonucleotide
  Target: FXN; (+) strand; PAM type: YTN; PAM sequence: CTA
ttcactttcaggcagtccca

SEQ ID NO: 32453 - DNA, 20 bp, Artificial Sequence
  Description of Artificial Sequence: Synthetic oligonucleotide
  Target: FXN; (+) strand; PAM type: YTN; PAM sequence: TTC
actttcaggcagtcccatgt

SEQ ID NO: 32454 - DNA, 20 bp, Artificial Sequence
  Description of Artificial Sequence: Synthetic oligonucleotide
  Target: FXN; (+) strand; PAM type: YTN; PAM sequence: CTT
tcaggcagtcccatgtgcca

SEQ ID NO: 32455 - DNA, 20 bp, Artificial Sequence
  Description of Artificial Sequence: Synthetic oligonucleotide
  Target: FXN; (+) strand; PAM type: YTN; PAM sequence: TTT
caggcagtcccatgtgccag

SEQ ID NO: 32456 - DNA, 20 bp, Artificial Sequence
  Description of Artificial Sequence: Synthetic oligonucleotide
  Target: FXN; (+) strand; PAM type: YTN; PAM sequence: TTC
aggcagtcccatgtgccagg

SEQ ID NO: 32457 - DNA, 20 bp, Artificial Sequence
  Description of Artificial Sequence: Synthetic oligonucleotide
  Target: FXN; (+) strand; PAM type: YTN; PAM sequence: TTT
cctccgtggatgggagtctc

SEQ ID NO: 32458 - DNA, 20 bp, Artificial Sequence
  Description of Artificial Sequence: Synthetic oligonucleotide
  Target: FXN; (+) strand; PAM type: YTN; PAM sequence: TTC
ctccgtggatgggagtctca

SEQ ID NO: 32459 - DNA, 20 bp, Artificial Sequence
  Description of Artificial Sequence: Synthetic oligonucleotide
  Target: FXN; (+) strand; PAM type: YTN; PAM sequence: CTC
cgtggatgggagtctcaggc

SEQ ID NO: 32460 - DNA, 20 bp, Artificial Sequence
  Description of Artificial Sequence: Synthetic oligonucleotide
  Target: FXN; (+) strand; PAM type: YTN; PAM sequence: CTC
aggctgccttatctccttgc

SEQ ID NO: 32461 - DNA, 20 bp, Artificial Sequence
  Description of Artificial Sequence: Synthetic oligonucleotide
  Target: FXN; (+) strand; PAM type: YTN; PAM sequence: CTG
ccttatctccttgcatgtcc

SEQ ID NO: 32462 - DNA, 20 bp, Artificial Sequence
  Description of Artificial Sequence: Synthetic oligonucleotide
  Target: FXN; (+) strand; PAM type: YTN; PAM sequence: CTT
atctccttgcatgtccccat

SEQ ID NO: 32463 - DNA, 20 bp, Artificial Sequence
  Description of Artificial Sequence: Synthetic oligonucleotide
  Target: FXN; (+) strand; PAM type: YTN; PAM sequence: TTA
tctccttgcatgtccccatg

SEQ ID NO: 32464 - DNA, 20 bp, Artificial Sequence
  Description of Artificial Sequence: Synthetic oligonucleotide
  Target: FXN; (+) strand; PAM type: YTN; PAM sequence: CTC
cttgcatgtccccatgccca

SEQ ID NO: 32465 - DNA, 20 bp, Artificial Sequence
  Description of Artificial Sequence: Synthetic oligonucleotide
  Target: FXN; (+) strand; PAM type: YTN; PAM sequence: CTT
gcatgtccccatgcccagct

SEQ ID NO: 32466 - DNA, 20 bp, Artificial Sequence
  Description of Artificial Sequence: Synthetic oligonucleotide
  Target: FXN; (+) strand; PAM type: YTN; PAM sequence: TTG
catgtccccatgcccagctg

SEQ ID NO: 32467 - DNA, 20 bp, Artificial Sequence
  Description of Artificial Sequence: Synthetic oligonucleotide
  Target: FXN; (+) strand; PAM type: YTN; PAM sequence: CTG
tctcagcctaagggcaggta

SEQ ID NO: 32468 - DNA, 20 bp, Artificial Sequence
  Description of Artificial Sequence: Synthetic oligonucleotide
  Target: FXN; (+) strand; PAM type: YTN; PAM sequence: CTC
agcctaagggcaggtacctt

SEQ ID NO: 32469 - DNA, 20 bp, Artificial Sequence
  Description of Artificial Sequence: Synthetic oligonucleotide
  Target: FXN; (+) strand; PAM type: YTN; PAM sequence: CTA
agggcaggtaccttgaagtc

SEQ ID NO: 32470 - DNA, 20 bp, Artificial Sequence
  Description of Artificial Sequence: Synthetic oligonucleotide
  Target: FXN; (+) strand; PAM type: YTN; PAM sequence: CTT
gaagtcaagttaaacaataa

SEQ ID NO: 32471 - DNA, 20 bp, Artificial Sequence
  Description of Artificial Sequence: Synthetic oligonucleotide
  Target: FXN; (+) strand; PAM type: YTN; PAM sequence: TTG
aagtcaagttaaacaataag

SEQ ID NO: 32472 - DNA, 20 bp, Artificial Sequence
  Description of Artificial Sequence: Synthetic oligonucleotide
  Target: FXN; (+) strand; PAM type: YTN; PAM sequence: TTA
aacaataagattggagacca

SEQ ID NO: 32473 - DNA, 20 bp, Artificial Sequence
  Description of Artificial Sequence: Synthetic oligonucleotide
  Target: FXN; (+) strand; PAM type: YTN; PAM sequence: TTG
gagaccagcaatgccctcag

SEQ ID NO: 32474 - DNA, 20 bp, Artificial Sequence
  Description of Artificial Sequence: Synthetic oligonucleotide
  Target: FXN; (+) strand; PAM type: YTN; PAM sequence: CTC
agcctggtttttgcagcagg

SEQ ID NO: 32475 - DNA, 20 bp, Artificial Sequence
  Description of Artificial Sequence: Synthetic oligonucleotide
  Target: FXN; (+) strand; PAM type: YTN; PAM sequence: CTG
gtttttgcagcaggactgag

SEQ ID NO: 32476 - DNA, 20 bp, Artificial Sequence
  Description of Artificial Sequence: Synthetic oligonucleotide
  Target: FXN; (+) strand; PAM type: YTN; PAM sequence: TTT
ttgcagcaggactgagtccc

SEQ ID NO: 32477 - DNA, 20 bp, Artificial Sequence
  Description of Artificial Sequence: Synthetic oligonucleotide
  Target: FXN; (+) strand; PAM type: YTN; PAM sequence: TTT
tgcagcaggactgagtccct

SEQ ID NO: 32478 - DNA, 20 bp, Artificial Sequence
  Description of Artificial Sequence: Synthetic oligonucleotide
  Target: FXN; (+) strand; PAM type: YTN; PAM sequence: TTT
gcagcaggactgagtccctt

SEQ ID NO: 32479 - DNA, 20 bp, Artificial Sequence
  Description of Artificial Sequence: Synthetic oligonucleotide
  Target: FXN; (+) strand; PAM type: YTN; PAM sequence: TTG
cagcaggactgagtcccttg

SEQ ID NO: 32480 - DNA, 20 bp, Artificial Sequence
  Description of Artificial Sequence: Synthetic oligonucleotide
  Target: FXN; (+) strand; PAM type: YTN; PAM sequence: CTG
agtcccttgttttggctcaa

SEQ ID NO: 32481 - DNA, 20 bp, Artificial Sequence
  Description of Artificial Sequence: Synthetic oligonucleotide
  Target: FXN; (+) strand; PAM type: YTN; PAM sequence: CTT
gttttggctcaatgggaagt

SEQ ID NO: 32482 - DNA, 20 bp, Artificial Sequence
  Description of Artificial Sequence: Synthetic oligonucleotide
  Target: FXN; (+) strand; PAM type: YTN; PAM sequence: TTG
ttttggctcaatgggaagtc

SEQ ID NO: 32483 - DNA, 20 bp, Artificial Sequence
  Description of Artificial Sequence: Synthetic oligonucleotide
  Target: FXN; (+) strand; PAM type: YTN; PAM sequence: TTT
tggctcaatgggaagtcttt

SEQ ID NO: 32484 - DNA, 20 bp, Artificial Sequence
  Description of Artificial Sequence: Synthetic oligonucleotide
  Target: FXN; (+) strand; PAM type: YTN; PAM sequence: TTT
ggctcaatgggaagtctttg

SEQ ID NO: 32485 - DNA, 20 bp, Artificial Sequence
  Description of Artificial Sequence: Synthetic oligonucleotide
  Target: FXN; (+) strand; PAM type: YTN; PAM sequence: TTG
gctcaatgggaagtctttgc

SEQ ID NO: 32486 - DNA, 20 bp, Artificial Sequence
  Description of Artificial Sequence: Synthetic oligonucleotide
  Target: FXN; (+) strand; PAM type: YTN; PAM sequence: CTC
aatgggaagtctttgctgtt

SEQ ID NO: 32487 - DNA, 20 bp, Artificial Sequence
  Description of Artificial Sequence: Synthetic oligonucleotide
  Target: FXN; (+) strand; PAM type: YTN; PAM sequence: CTT
tgctgttcaaagccttagct

SEQ ID NO: 32488 - DNA, 20 bp, Artificial Sequence
  Description of Artificial Sequence: Synthetic oligonucleotide
  Target: FXN; (+) strand; PAM type: YTN; PAM sequence: TTT
gctgttcaaagccttagctt

SEQ ID NO: 32489 - DNA, 20 bp, Artificial Sequence
  Description of Artificial Sequence: Synthetic oligonucleotide
  Target: FXN; (+) strand; PAM type: YTN; PAM sequence: TTG
ctgttcaaagccttagcttc

SEQ ID NO: 32490 - DNA, 20 bp, Artificial Sequence
  Description of Artificial Sequence: Synthetic oligonucleotide
  Target: FXN; (+) strand; PAM type: YTN; PAM sequence: CTG
ttcaaagccttagcttctct

SEQ ID NO: 32491 - DNA, 20 bp, Artificial Sequence
  Description of Artificial Sequence: Synthetic oligonucleotide
  Target: FXN; (+) strand; PAM type: YTN; PAM sequence: TTC
aaagccttagcttctctggc

SEQ ID NO: 32492 - DNA, 20 bp, Artificial Sequence
  Description of Artificial Sequence: Synthetic oligonucleotide
  Target: FXN; (+) strand; PAM type: YTN; PAM sequence: CTT
agcttctctggctgagtgcg

SEQ ID NO: 32493 - DNA, 20 bp, Artificial Sequence
  Description of Artificial Sequence: Synthetic oligonucleotide
  Target: FXN; (+) strand; PAM type: YTN; PAM sequence: TTA
gcttctctggctgagtgcgg

SEQ ID NO: 32494 - DNA, 20 bp, Artificial Sequence
  Description of Artificial Sequence: Synthetic oligonucleotide
  Target: FXN; (+) strand; PAM type: YTN; PAM sequence: CTT
ctctggctgagtgcggtggc

SEQ ID NO: 32495 - DNA, 20 bp, Artificial Sequence
  Description of Artificial Sequence: Synthetic oligonucleotide
  Target: FXN; (+) strand; PAM type: YTN; PAM sequence: TTC
tctggctgagtgcggtggct

SEQ ID NO: 32496 - DNA, 20 bp, Artificial Sequence
  Description of Artificial Sequence: Synthetic oligonucleotide
  Target: FXN; (+) strand; PAM type: YTN; PAM sequence: CTC
tggctgagtgcggtggctca

SEQ ID NO: 32497 - DNA, 20 bp, Artificial Sequence
  Description of Artificial Sequence: Synthetic oligonucleotide
  Target: FXN; (+) strand; PAM type: YTN; PAM sequence: CTG
gctgagtgcggtggctcacg

SEQ ID NO: 32498 - DNA, 20 bp, Artificial Sequence
  Description of Artificial Sequence: Synthetic oligonucleotide
  Target: FXN; (+) strand; PAM type: YTN; PAM sequence: CTG
agtgcggtggctcacgcctg

SEQ ID NO: 32499 - DNA, 20 bp, Artificial Sequence
  Description of Artificial Sequence: Synthetic oligonucleotide
  Target: FXN; (+) strand; PAM type: YTN; PAM sequence: CTC
acgcctgtcatcctagctct

SEQ ID NO: 32500 - DNA, 20 bp, Artificial Sequence
  Description of Artificial Sequence: Synthetic oligonucleotide
  Target: FXN; (+) strand; PAM type: YTN; PAM sequence: CTG
tcatcctagctctttgggag

SEQ ID NO: 32501 - DNA, 20 bp, Artificial Sequence
  Description of Artificial Sequence: Synthetic oligonucleotide
  Target: FXN; (+) strand; PAM type: YTN; PAM sequence: CTA
gctctttgggaggccgaggt

SEQ ID NO: 32502 - DNA, 20 bp, Artificial Sequence
  Description of Artificial Sequence: Synthetic oligonucleotide
  Target: FXN; (+) strand; PAM type: YTN; PAM sequence: CTC
tttgggaggccgaggtgagc

SEQ ID NO: 32503 - DNA, 20 bp, Artificial Sequence
  Description of Artificial Sequence: Synthetic oligonucleotide
  Target: FXN; (+) strand; PAM type: YTN; PAM sequence: CTT
tgggaggccgaggtgagcag

SEQ ID NO: 32504 - DNA, 20 bp, Artificial Sequence
  Description of Artificial Sequence: Synthetic oligonucleotide
  Target: FXN; (+) strand; PAM type: YTN; PAM sequence: TTT
gggaggccgaggtgagcaga

SEQ ID NO: 32505 - DNA, 20 bp, Artificial Sequence
  Description of Artificial Sequence: Synthetic oligonucleotide
  Target: FXN; (+) strand; PAM type: YTN; PAM sequence: TTG
ggaggccgaggtgagcagat

SEQ ID NO: 32506 - DNA, 20 bp, Artificial Sequence
  Description of Artificial Sequence: Synthetic oligonucleotide
  Target: FXN; (+) strand; PAM type: YTN; PAM sequence: CTG
aggccaggagttcaagacca

SEQ ID NO: 32507 - DNA, 20 bp, Artificial Sequence
  Description of Artificial Sequence: Synthetic oligonucleotide
  Target: FXN; (+) strand; PAM type: YTN; PAM sequence: TTC
aagaccagcctggccaacat

SEQ ID NO: 32508 - DNA, 20 bp, Artificial Sequence
  Description of Artificial Sequence: Synthetic oligonucleotide
  Target: FXN; (+) strand; PAM type: YTN; PAM sequence: CTG
gccaacatggtgaaaccctg

SEQ ID NO: 32509 - DNA, 20 bp, Artificial Sequence
  Description of Artificial Sequence: Synthetic oligonucleotide
  Target: FXN; (+) strand; PAM type: YTN; PAM sequence: CTG
tctctactaaaaatacaaaa

SEQ ID NO: 32510 - DNA, 20 bp, Artificial Sequence
  Description of Artificial Sequence: Synthetic oligonucleotide
  Target: FXN; (+) strand; PAM type: YTN; PAM sequence: CTC
tactaaaaatacaaaaagtt

SEQ ID NO: 32511 - DNA, 20 bp, Artificial Sequence
  Description of Artificial Sequence: Synthetic oligonucleotide
  Target: FXN; (+) strand; PAM type: YTN; PAM sequence: CTA
ctaaaaatacaaaaagttag

SEQ ID NO: 32512 - DNA, 20 bp, Artificial Sequence
  Description of Artificial Sequence: Synthetic oligonucleotide
  Target: FXN; (+) strand; PAM type: YTN; PAM sequence: CTA
aaaatacaaaaagttagcca

SEQ ID NO: 32513 - DNA, 20 bp, Artificial Sequence
  Description of Artificial Sequence: Synthetic oligonucleotide
  Target: FXN; (+) strand; PAM type: YTN; PAM sequence: TTA
gccaggcgtggtggcaggca

SEQ ID NO: 32514 - DNA, 20 bp, Artificial Sequence
  Description of Artificial Sequence: Synthetic oligonucleotide
  Target: FXN; (+) strand; PAM type: YTN; PAM sequence: CTG
taatcccagctactcgggag

SEQ ID NO: 32515 - DNA, 20 bp, Artificial Sequence
  Description of Artificial Sequence: Synthetic oligonucleotide
  Target: FXN; (+) strand; PAM type: YTN; PAM sequence: CTA
ctcgggagcctgaggcagga

SEQ ID NO: 32516 - DNA, 20 bp, Artificial Sequence
  Description of Artificial Sequence: Synthetic oligonucleotide
  Target: FXN; (+) strand; PAM type: YTN; PAM sequence: CTC
gggagcctgaggcaggagaa

SEQ ID NO: 32517 - DNA, 20 bp, Artificial Sequence
  Description of Artificial Sequence: Synthetic oligonucleotide
  Target: FXN; (+) strand; PAM type: YTN; PAM sequence: CTG
aggcaggagaatcgcttaaa

SEQ ID NO: 32518 - DNA, 20 bp, Artificial Sequence
  Description of Artificial Sequence: Synthetic oligonucleotide
  Target: FXN; (+) strand; PAM type: YTN; PAM sequence: CTT
aaacccaggagatggaggct

SEQ ID NO: 32519 - DNA, 20 bp, Artificial Sequence
  Description of Artificial Sequence: Synthetic oligonucleotide
  Target: FXN; (+) strand; PAM type: YTN; PAM sequence: TTA
aacccaggagatggaggctg

SEQ ID NO: 32520 - DNA, 20 bp, Artificial Sequence
  Description of Artificial Sequence: Synthetic oligonucleotide
  Target: FXN; (+) strand; PAM type: YTN; PAM sequence: CTG
cagtgagctgagatcatgcc

SEQ ID NO: 32521 - DNA, 20 bp, Artificial Sequence
  Description of Artificial Sequence: Synthetic oligonucleotide
  Target: FXN; (+) strand; PAM type: YTN; PAM sequence: CTG
agatcatgccattgcactcc

SEQ ID NO: 32522 - DNA, 20 bp, Artificial Sequence
  Description of Artificial Sequence: Synthetic oligonucleotide
  Target: FXN; (+) strand; PAM type: YTN; PAM sequence: TTG
cactccagcctgggtaacga

SEQ ID NO: 32523 - DNA, 20 bp, Artificial Sequence
  Description of Artificial Sequence: Synthetic oligonucleotide
  Target: FXN; (+) strand; PAM type: YTN; PAM sequence: CTC
cagcctgggtaacgagcgaa

SEQ ID NO: 32524 - DNA, 20 bp, Artificial Sequence
  Description of Artificial Sequence: Synthetic oligonucleotide
  Target: FXN; (+) strand; PAM type: YTN; PAM sequence: CTG
ggtaacgagcgaaattccat

SEQ ID NO: 32525 - DNA, 20 bp, Artificial Sequence
  Description of Artificial Sequence: Synthetic oligonucleotide
  Target: FXN; (+) strand; PAM type: YTN; PAM sequence: TTC
catctctaaaaaaaagaaaa

SEQ ID NO: 32526 - DNA, 20 bp, Artificial Sequence
  Description of Artificial Sequence: Synthetic oligonucleotide
  Target: FXN; (+) strand; PAM type: YTN; PAM sequence: CTC
taaaaaaaagaaaaaaaaaa

SEQ ID NO: 32527 - DNA, 20 bp, Artificial Sequence
  Description of Artificial Sequence: Synthetic oligonucleotide
  Target: FXN; (+) strand; PAM type: YTN; PAM sequence: CTA
aaaaaaagaaaaaaaaaagg

SEQ ID NO: 32528 - DNA, 20 bp, Artificial Sequence
  Description of Artificial Sequence: Synthetic oligonucleotide
  Target: FXN; (+) strand; PAM type: YTN; PAM sequence: CTT
agattctccctttgactttc

SEQ ID NO: 32529 - DNA, 20 bp, Artificial Sequence
  Description of Artificial Sequence: Synthetic oligonucleotide
  Target: FXN; (+) strand; PAM type: YTN; PAM sequence: TTA
gattctccctttgactttcc

SEQ ID NO: 32530 - DNA, 20 bp, Artificial Sequence
  Description of Artificial Sequence: Synthetic oligonucleotide
  Target: FXN; (+) strand; PAM type: YTN; PAM sequence: TTC
tccctttgactttccacgtt

SEQ ID NO: 32531 - DNA, 20 bp, Artificial Sequence
  Description of Artificial Sequence: Synthetic oligonucleotide
  Target: FXN; (+) strand; PAM type: YTN; PAM sequence: CTC
cctttgactttccacgtttg

SEQ ID NO: 32532 - DNA, 20 bp, Artificial Sequence
  Description of Artificial Sequence: Synthetic oligonucleotide
  Target: FXN; (+) strand; PAM type: YTN; PAM sequence: CTT
tgactttccacgtttgtgca

SEQ ID NO: 32533 - DNA, 20 bp, Artificial Sequence
  Description of Artificial Sequence: Synthetic oligonucleotide
  Target: FXN; (+) strand; PAM type: YTN; PAM sequence: TTT
gactttccacgtttgtgcag

SEQ ID NO: 32534 - DNA, 20 bp, Artificial Sequence
  Description of Artificial Sequence: Synthetic oligonucleotide
  Target: FXN; (+) strand; PAM type: YTN; PAM sequence: TTG
actttccacgtttgtgcagc

SEQ ID NO: 32535 - DNA, 20 bp, Artificial Sequence
  Description of Artificial Sequence: Synthetic oligonucleotide
  Target: FXN; (+) strand; PAM type: YTN; PAM sequence: CTT
tccacgtttgtgcagccttt

SEQ ID NO: 32536 - DNA, 20 bp, Artificial Sequence
  Description of Artificial Sequence: Synthetic oligonucleotide
  Target: FXN; (+) strand; PAM type: YTN; PAM sequence: TTT
ccacgtttgtgcagcctttt

SEQ ID NO: 32537 - DNA, 20 bp, Artificial Sequence
  Description of Artificial Sequence: Synthetic oligonucleotide
  Target: FXN; (+) strand; PAM type: YTN; PAM sequence: TTC
cacgtttgtgcagcctttta

SEQ ID NO: 32538 - DNA, 20 bp, Artificial Sequence
  Description of Artificial Sequence: Synthetic oligonucleotide
  Target: FXN; (+) strand; PAM type: YTN; PAM sequence: TTT
gtgcagccttttatctccaa

SEQ ID NO: 32539 - DNA, 20 bp, Artificial Sequence
  Description of Artificial Sequence: Synthetic oligonucleotide
  Target: FXN; (+) strand; PAM type: YTN; PAM sequence: TTG
tgcagccttttatctccaat

SEQ ID NO: 32540 - DNA, 20 bp, Artificial Sequence
  Description of Artificial Sequence: Synthetic oligonucleotide
  Target: FXN; (+) strand; PAM type: YTN; PAM sequence: CTT
ttatctccaatgctccattt

SEQ ID NO: 32541 - DNA, 20 bp, Artificial Sequence
  Description of Artificial Sequence: Synthetic oligonucleotide
  Target: FXN; (+) strand; PAM type: YTN; PAM sequence: TTT
tatctccaatgctccatttc

SEQ ID NO: 32542 - DNA, 20 bp, Artificial Sequence
  Description of Artificial Sequence: Synthetic oligonucleotide
  Target: FXN; (+) strand; PAM type: YTN; PAM sequence: TTT
atctccaatgctccatttca

SEQ ID NO: 32543 - DNA, 20 bp, Artificial Sequence
  Description of Artificial Sequence: Synthetic oligonucleotide
  Target: FXN; (+) strand; PAM type: YTN; PAM sequence: TTA
tctccaatgctccatttcat

SEQ ID NO: 32544 - DNA, 20 bp, Artificial Sequence
  Description of Artificial Sequence: Synthetic oligonucleotide
  Target: FXN; (+) strand; PAM type: YTN; PAM sequence: CTC
caatgctccatttcattcca

SEQ ID NO: 32545 - DNA, 20 bp, Artificial Sequence
  Description of Artificial Sequence: Synthetic oligonucleotide
  Target: FXN; (+) strand; PAM type: YTN; PAM sequence: CTC
catttcattccatctcctgg

SEQ ID NO: 32546 - DNA, 20 bp, Artificial Sequence
  Description of Artificial Sequence: Synthetic oligonucleotide
  Target: FXN; (+) strand; PAM type: YTN; PAM sequence: TTT
cattccatctcctggcttat

SEQ ID NO: 32547 - DNA, 20 bp, Artificial Sequence
  Description of Artificial Sequence: Synthetic oligonucleotide
  Target: FXN; (+) strand; PAM type: YTN; PAM sequence: TTC
attccatctcctggcttatt

SEQ ID NO: 32548 - DNA, 20 bp, Artificial Sequence
  Description of Artificial Sequence: Synthetic oligonucleotide
  Target: FXN; (+) strand; PAM type: YTN; PAM sequence: TTC
catctcctggcttattcttt

SEQ ID NO: 32549 - DNA, 20 bp, Artificial Sequence
  Description of Artificial Sequence: Synthetic oligonucleotide
  Target: FXN; (+) strand; PAM type: YTN; PAM sequence: CTC
ctggcttattcttttcttgt

SEQ ID NO: 32550 - DNA, 20 bp, Artificial Sequence
  Description of Artificial Sequence: Synthetic oligonucleotide
  Target: FXN; (+) strand; PAM type: YTN; PAM sequence: CTG
gcttattcttttcttgtcac

SEQ ID NO: 32551 - DNA, 20 bp, Artificial Sequence
  Description of Artificial Sequence: Synthetic oligonucleotide
  Target: FXN; (+) strand; PAM type: YTN; PAM sequence: CTT
attcttttcttgtcacatct

SEQ ID NO: 32552 - DNA, 20 bp, Artificial Sequence
  Description of Artificial Sequence: Synthetic oligonucleotide
  Target: FXN; (+) strand; PAM type: YTN; PAM sequence: TTA
ttcttttcttgtcacatcta

SEQ ID NO: 32553 - DNA, 20 bp, Artificial Sequence
  Description of Artificial Sequence: Synthetic oligonucleotide
  Target: FXN; (+) strand; PAM type: YTN; PAM sequence: TTC
ttttcttgtcacatctacta

SEQ ID NO: 32554 - DNA, 20 bp, Artificial Sequence
  Description of Artificial Sequence: Synthetic oligonucleotide
  Target: FXN; (+) strand; PAM type: YTN; PAM sequence: CTT
ttcttgtcacatctactaaa

SEQ ID NO: 32555 - DNA, 20 bp, Artificial Sequence
  Description of Artificial Sequence: Synthetic oligonucleotide
  Target: FXN; (+) strand; PAM type: YTN; PAM sequence: TTT
tcttgtcacatctactaaaa

SEQ ID NO: 32556 - DNA, 20 bp, Artificial Sequence
  Description of Artificial Sequence: Synthetic oligonucleotide
  Target: FXN; (+) strand; PAM type: YTN; PAM sequence: TTT
cttgtcacatctactaaaag

SEQ ID NO: 32557 - DNA, 20 bp, Artificial Sequence
  Description of Artificial Sequence: Synthetic oligonucleotide
  Target: FXN; (+) strand; PAM type: YTN; PAM sequence: TTC
ttgtcacatctactaaaagc

SEQ ID NO: 32558 - DNA, 20 bp, Artificial Sequence
  Description of Artificial Sequence: Synthetic oligonucleotide
  Target: FXN; (+) strand; PAM type: YTN; PAM sequence: CTT
gtcacatctactaaaagcaa

SEQ ID NO: 32559 - DNA, 20 bp, Artificial Sequence
  Description of Artificial Sequence: Synthetic oligonucleotide
  Target: FXN; (+) strand; PAM type: YTN; PAM sequence: TTG
tcacatctactaaaagcaac

SEQ ID NO: 32560 - DNA, 20 bp, Artificial Sequence
  Description of Artificial Sequence: Synthetic oligonucleotide
  Target: FXN; (+) strand; PAM type: YTN; PAM sequence: CTA
ctaaaagcaacaagaagcca

SEQ ID NO: 32561 - DNA, 20 bp, Artificial Sequence
  Description of Artificial Sequence: Synthetic oligonucleotide
  Target: FXN; (+) strand; PAM type: YTN; PAM sequence: CTA
aaagcaacaagaagccaccg

SEQ ID NO: 32562 - DNA, 20 bp, Artificial Sequence
  Description of Artificial Sequence: Synthetic oligonucleotide
  Target: FXN; (+) strand; PAM type: YTN; PAM sequence: TTC
aggaacattctacctgtccc

SEQ ID NO: 32563 - DNA, 20 bp, Artificial Sequence
  Description of Artificial Sequence: Synthetic oligonucleotide
  Target: FXN; (+) strand; PAM type: YTN; PAM sequence: TTC
tacctgtccccagagctata

SEQ ID NO: 32564 - DNA, 20 bp, Artificial Sequence
  Description of Artificial Sequence: Synthetic oligonucleotide
  Target: FXN; (+) strand; PAM type: YTN; PAM sequence: CTA
cctgtccccagagctatatg

SEQ ID NO: 32565 - DNA, 20 bp, Artificial Sequence
  Description of Artificial Sequence: Synthetic oligonucleotide
  Target: FXN; (+) strand; PAM type: YTN; PAM sequence: CTG
tccccagagctatatgctca

SEQ ID NO: 32566 - DNA, 20 bp, Artificial Sequence
  Description of Artificial Sequence: Synthetic oligonucleotide
  Target: FXN; (+) strand; PAM type: YTN; PAM sequence: CTA
tatgctcagtaggcatacag

SEQ ID NO: 32567 - DNA, 20 bp, Artificial Sequence
  Description of Artificial Sequence: Synthetic oligonucleotide
  Target: FXN; (+) strand; PAM type: YTN; PAM sequence: CTC
agtaggcatacagttggccc

SEQ ID NO: 32568 - DNA, 20 bp, Artificial Sequence
  Description of Artificial Sequence: Synthetic oligonucleotide
  Target: FXN; (+) strand; PAM type: YTN; PAM sequence: TTG
gccctccaggttatctgaga

SEQ ID NO: 32569 - DNA, 20 bp, Artificial Sequence
  Description of Artificial Sequence: Synthetic oligonucleotide
  Target: FXN; (+) strand; PAM type: YTN; PAM sequence: CTC
caggttatctgagactcaga

SEQ ID NO: 32570 - DNA, 20 bp, Artificial Sequence
  Description of Artificial Sequence: Synthetic oligonucleotide
  Target: FXN; (+) strand; PAM type: YTN; PAM sequence: TTA
tctgagactcagatttccag

SEQ ID NO: 32571 - DNA, 20 bp, Artificial Sequence
  Description of Artificial Sequence: Synthetic oligonucleotide
  Target: FXN; (+) strand; PAM type: YTN; PAM sequence: CTG
agactcagatttccagaggg

SEQ ID NO: 32572 - DNA, 20 bp, Artificial Sequence
  Description of Artificial Sequence: Synthetic oligonucleotide
  Target: FXN; (+) strand; PAM type: YTN; PAM sequence: CTC
agatttccagagggctttgc

SEQ ID NO: 32573 - DNA, 20 bp, Artificial Sequence
  Description of Artificial Sequence: Synthetic oligonucleotide
  Target: FXN; (+) strand; PAM type: YTN; PAM sequence: TTT
ccagagggctttgcatggct

SEQ ID NO: 32574 - DNA, 20 bp, Artificial Sequence
  Description of Artificial Sequence: Synthetic oligonucleotide
  Target: FXN; (+) strand; PAM type: YTN; PAM sequence: TTC
cagagggctttgcatggctc

SEQ ID NO: 32575 - DNA, 20 bp, Artificial Sequence
  Description of Artificial Sequence: Synthetic oligonucleotide
  Target: FXN; (+) strand; PAM type: YTN; PAM sequence: CTT
tgcatggctcacaaggtctg

SEQ ID NO: 32576 - DNA, 20 bp, Artificial Sequence
  Description of Artificial Sequence: Synthetic oligonucleotide
  Target: FXN; (+) strand; PAM type: YTN; PAM sequence: TTT
gcatggctcacaaggtctga

SEQ ID NO: 32577 - DNA, 20 bp, Artificial Sequence
  Description of Artificial Sequence: Synthetic oligonucleotide
  Target: FXN; (+) strand; PAM type: YTN; PAM sequence: TTG
catggctcacaaggtctgaa

SEQ ID NO: 32578 - DNA, 20 bp, Artificial Sequence
  Description of Artificial Sequence: Synthetic oligonucleotide
  Target: FXN; (+) strand; PAM type: YTN; PAM sequence: CTC
acaaggtctgaagaacctct

SEQ ID NO: 32579 - DNA, 20 bp, Artificial Sequence
  Description of Artificial Sequence: Synthetic oligonucleotide
  Target: FXN; (+) strand; PAM type: YTN; PAM sequence: CTG
aagaacctctgagcctcccg

SEQ ID NO: 32580 - DNA, 20 bp, Artificial Sequence
  Description of Artificial Sequence: Synthetic oligonucleotide
  Target: FXN; (+) strand; PAM type: YTN; PAM sequence: CTC
tgagcctcccgcctgcggtg

SEQ ID NO: 32581 - DNA, 20 bp, Artificial Sequence
  Description of Artificial Sequence: Synthetic oligonucleotide
  Target: FXN; (+) strand; PAM type: YTN; PAM sequence: CTG
agcctcccgcctgcggtgtc

SEQ ID NO: 32582 - DNA, 20 bp, Artificial Sequence
  Description of Artificial Sequence: Synthetic oligonucleotide
  Target: FXN; (+) strand; PAM type: YTN; PAM sequence: CTC
ccgcctgcggtgtctgttca

SEQ ID NO: 32583 - DNA, 20 bp, Artificial Sequence
  Description of Artificial Sequence: Synthetic oligonucleotide
  Target: FXN; (+) strand; PAM type: YTN; PAM sequence: CTG
cggtgtctgttcattgactt

SEQ ID NO: 32584 - DNA, 20 bp, Artificial Sequence
  Description of Artificial Sequence: Synthetic oligonucleotide
  Target: FXN; (+) strand; PAM type: YTN; PAM sequence: CTG
ttcattgactttgccacagt

SEQ ID NO: 32585 - DNA, 20 bp, Artificial Sequence
  Description of Artificial Sequence: Synthetic oligonucleotide
  Target: FXN; (+) strand; PAM type: YTN; PAM sequence: TTC
attgactttgccacagtctc

SEQ ID NO: 32586 - DNA, 20 bp, Artificial Sequence
  Description of Artificial Sequence: Synthetic oligonucleotide
  Target: FXN; (+) strand; PAM type: YTN; PAM sequence: TTG
actttgccacagtctcaaag

SEQ ID NO: 32587 - DNA, 20 bp, Artificial Sequence
  Description of Artificial Sequence: Synthetic oligonucleotide
  Target: FXN; (+) strand; PAM type: YTN; PAM sequence: CTT
tgccacagtctcaaagaggc

SEQ ID NO: 32588 - DNA, 20 bp, Artificial Sequence
  Description of Artificial Sequence: Synthetic oligonucleotide
  Target: FXN; (+) strand; PAM type: YTN; PAM sequence: TTT
gccacagtctcaaagaggca

SEQ ID NO: 32589 - DNA, 20 bp, Artificial Sequence
  Description of Artificial Sequence: Synthetic oligonucleotide
  Target: FXN; (+) strand; PAM type: YTN; PAM sequence: TTG
ccacagtctcaaagaggcac

SEQ ID NO: 32590 - DNA, 20 bp, Artificial Sequence
  Description of Artificial Sequence: Synthetic oligonucleotide
  Target: FXN; (+) strand; PAM type: YTN; PAM sequence: CTC
aaagaggcactgcatgctgc

SEQ ID NO: 32591 - DNA, 20 bp, Artificial Sequence
  Description of Artificial Sequence: Synthetic oligonucleotide
  Target: FXN; (+) strand; PAM type: YTN; PAM sequence: CTG
catgctgcatgtttgaggtt

SEQ ID NO: 32592 - DNA, 20 bp, Artificial Sequence
  Description of Artificial Sequence: Synthetic oligonucleotide
  Target: FXN; (+) strand; PAM type: YTN; PAM sequence: CTG
catgtttgaggtttttgctt

SEQ ID NO: 32593 - DNA, 20 bp, Artificial Sequence
  Description of Artificial Sequence: Synthetic oligonucleotide
  Target: FXN; (+) strand; PAM type: YTN; PAM sequence: TTT
gaggtttttgctttggtggc

SEQ ID NO: 32594 - DNA, 20 bp, Artificial Sequence
  Description of Artificial Sequence: Synthetic oligonucleotide
  Target: FXN; (+) strand; PAM type: YTN; PAM sequence: TTG
aggtttttgctttggtggca

SEQ ID NO: 32595 - DNA, 20 bp, Artificial Sequence
  Description of Artificial Sequence: Synthetic oligonucleotide
  Target: FXN; (+) strand; PAM type: YTN; PAM sequence: TTT
ttgctttggtggcatccatt

SEQ ID NO: 32596 - DNA, 20 bp, Artificial Sequence
  Description of Artificial Sequence: Synthetic oligonucleotide
  Target: FXN; (+) strand; PAM type: YTN; PAM sequence: TTT
tgctttggtggcatccattt

SEQ ID NO: 32597 - DNA, 20 bp, Artificial Sequence
  Description of Artificial Sequence: Synthetic oligonucleotide
  Target: FXN; (+) strand; PAM type: YTN; PAM sequence: TTT
gctttggtggcatccatttc

SEQ ID NO: 32598 - DNA, 20 bp, Artificial Sequence
  Description of Artificial Sequence: Synthetic oligonucleotide
  Target: FXN; (+) strand; PAM type: YTN; PAM sequence: TTG
ctttggtggcatccatttcc

SEQ ID NO: 32599 - DNA, 20 bp, Artificial Sequence
  Description of Artificial Sequence: Synthetic oligonucleotide
  Target: FXN; (+) strand; PAM type: YTN; PAM sequence: CTT
tggtggcatccatttccagc

SEQ ID NO: 32600 - DNA, 20 bp, Artificial Sequence
  Description of Artificial Sequence: Synthetic oligonucleotide
  Target: FXN; (+) strand; PAM type: YTN; PAM sequence: TTT
ggtggcatccatttccagcc

SEQ ID NO: 32601 - DNA, 20 bp, Artificial Sequence
  Description of Artificial Sequence: Synthetic oligonucleotide
  Target: FXN; (+) strand; PAM type: YTN; PAM sequence: TTG
gtggcatccatttccagcct

SEQ ID NO: 32602 - DNA, 20 bp, Artificial Sequence
  Description of Artificial Sequence: Synthetic oligonucleotide
  Target: FXN; (+) strand; PAM type: YTN; PAM sequence: TTT
ccagcctcggcttccggcat

SEQ ID NO: 32603 - DNA, 20 bp, Artificial Sequence
  Description of Artificial Sequence: Synthetic oligonucleotide
  Target: FXN; (+) strand; PAM type: YTN; PAM sequence: TTC
cagcctcggcttccggcatt

SEQ ID NO: 32604 - DNA, 20 bp, Artificial Sequence
  Description of Artificial Sequence: Synthetic oligonucleotide
  Target: FXN; (+) strand; PAM type: YTN; PAM sequence: CTC
ggcttccggcattcctcccc

SEQ ID NO: 32605 - DNA, 20 bp, Artificial Sequence
  Description of Artificial Sequence: Synthetic oligonucleotide
  Target: FXN; (+) strand; PAM type: YTN; PAM sequence: CTT
ccggcattcctcccccagca

SEQ ID NO: 32606 - DNA, 20 bp, Artificial Sequence
  Description of Artificial Sequence: Synthetic oligonucleotide
  Target: FXN; (+) strand; PAM type: YTN; PAM sequence: TTC
cggcattcctcccccagcag

SEQ ID NO: 32607 - DNA, 20 bp, Artificial Sequence
  Description of Artificial Sequence: Synthetic oligonucleotide
  Target: FXN; (+) strand; PAM type: YTN; PAM sequence: TTC
ctcccccagcagactctctg

SEQ ID NO: 32608 - DNA, 20 bp, Artificial Sequence
  Description of Artificial Sequence: Synthetic oligonucleotide
  Target: FXN; (+) strand; PAM type: YTN; PAM sequence: CTC
ccccagcagactctctgctg

SEQ ID NO: 32609 - DNA, 20 bp, Artificial Sequence
  Description of Artificial Sequence: Synthetic oligonucleotide
  Target: FXN; (+) strand; PAM type: YTN; PAM sequence: CTC
tctgctgctttccccttact

SEQ ID NO: 32610 - DNA, 20 bp, Artificial Sequence
  Description of Artificial Sequence: Synthetic oligonucleotide
  Target: FXN; (+) strand; PAM type: YTN; PAM sequence: CTC
tgctgctttccccttactcc

SEQ ID NO: 32611 - DNA, 20 bp, Artificial Sequence
  Description of Artificial Sequence: Synthetic oligonucleotide
  Target: FXN; (+) strand; PAM type: YTN; PAM sequence: CTG
ctgctttccccttactcctt

SEQ ID NO: 32612 - DNA, 20 bp, Artificial Sequence
  Description of Artificial Sequence: Synthetic oligonucleotide
  Target: FXN; (+) strand; PAM type: YTN; PAM sequence: CTG
ctttccccttactccttctg

SEQ ID NO: 32613 - DNA, 20 bp, Artificial Sequence
  Description of Artificial Sequence: Synthetic oligonucleotide
  Target: FXN; (+) strand; PAM type: YTN; PAM sequence: CTT
tccccttactccttctggca

SEQ ID NO: 32614 - DNA, 20 bp, Artificial Sequence
  Description of Artificial Sequence: Synthetic oligonucleotide
  Target: FXN; (+) strand; PAM type: YTN; PAM sequence: TTT
ccccttactccttctggcag

SEQ ID NO: 32615 - DNA, 20 bp, Artificial Sequence
  Description of Artificial Sequence: Synthetic oligonucleotide
  Target: FXN; (+) strand; PAM type: YTN; PAM sequence: TTC
cccttactccttctggcagt

SEQ ID NO: 32616 - DNA, 20 bp, Artificial Sequence
  Description of Artificial Sequence: Synthetic oligonucleotide
  Target: FXN; (+) strand; PAM type: YTN; PAM sequence: CTT
actccttctggcagttctgg

SEQ ID NO: 32617 - DNA, 20 bp, Artificial Sequence
  Description of Artificial Sequence: Synthetic oligonucleotide
  Target: FXN; (+) strand; PAM type: YTN; PAM sequence: TTA
ctccttctggcagttctggg

SEQ ID NO: 32618 - DNA, 20 bp, Artificial Sequence
  Description of Artificial Sequence: Synthetic oligonucleotide
  Target: FXN; (+) strand; PAM type: YTN; PAM sequence: CTC
cttctggcagttctgggagg

SEQ ID NO: 32619 - DNA, 20 bp, Artificial Sequence
  Description of Artificial Sequence: Synthetic oligonucleotide
  Target: FXN; (+) strand; PAM type: YTN; PAM sequence: CTT
ctggcagttctgggaggttg

SEQ ID NO: 32620 - DNA, 20 bp, Artificial Sequence
  Description of Artificial Sequence: Synthetic oligonucleotide
  Target: FXN; (+) strand; PAM type: YTN; PAM sequence: TTC
tggcagttctgggaggttgc

SEQ ID NO: 32621 - DNA, 20 bp, Artificial Sequence
  Description of Artificial Sequence: Synthetic oligonucleotide
  Target: FXN; (+) strand; PAM type: YTN; PAM sequence: CTG
gcagttctgggaggttgcat

SEQ ID NO: 32622 - DNA, 20 bp, Artificial Sequence
  Description of Artificial Sequence: Synthetic oligonucleotide
  Target: FXN; (+) strand; PAM type: YTN; PAM sequence: TTC
tgggaggttgcatagggccc

SEQ ID NO: 32623 - DNA, 20 bp, Artificial Sequence
  Description of Artificial Sequence: Synthetic oligonucleotide
  Target: FXN; (+) strand; PAM type: YTN; PAM sequence: CTG
ggaggttgcatagggccctt

SEQ ID NO: 32624 - DNA, 20 bp, Artificial Sequence
  Description of Artificial Sequence: Synthetic oligonucleotide
  Target: FXN; (+) strand; PAM type: YTN; PAM sequence: TTG
catagggcccttgcaggatg

SEQ ID NO: 32625 - DNA, 20 bp, Artificial Sequence
  Description of Artificial Sequence: Synthetic oligonucleotide
  Target: FXN; (+) strand; PAM type: YTN; PAM sequence: CTT
gcaggatgccccaagtccag

SEQ ID NO: 32626 - DNA, 20 bp, Artificial Sequence
  Description of Artificial Sequence: Synthetic oligonucleotide
  Target: FXN; (+) strand; PAM type: YTN; PAM sequence: TTG
caggatgccccaagtccagc

SEQ ID NO: 32627 - DNA, 20 bp, Artificial Sequence
  Description of Artificial Sequence: Synthetic oligonucleotide
  Target: FXN; (+) strand; PAM type: YTN; PAM sequence: CTG
cctctggcctctgggaagca

SEQ ID NO: 32628 - DNA, 20 bp, Artificial Sequence
  Description of Artificial Sequence: Synthetic oligonucleotide
  Target: FXN; (+) strand; PAM type: YTN; PAM sequence: CTC
tggcctctgggaagcacacc

SEQ ID NO: 32629 - DNA, 20 bp, Artificial Sequence
  Description of Artificial Sequence: Synthetic oligonucleotide
  Target: FXN; (+) strand; PAM type: YTN; PAM sequence: CTG
gcctctgggaagcacaccct

SEQ ID NO: 32630 - DNA, 20 bp, Artificial Sequence
  Description of Artificial Sequence: Synthetic oligonucleotide
  Target: FXN; (+) strand; PAM type: YTN; PAM sequence: CTC
tgggaagcacacccttgacc

SEQ ID NO: 32631 - DNA, 20 bp, Artificial Sequence
  Description of Artificial Sequence: Synthetic oligonucleotide
  Target: FXN; (+) strand; PAM type: YTN; PAM sequence: CTG
ggaagcacacccttgacctg

SEQ ID NO: 32632 - DNA, 20 bp, Artificial Sequence
  Description of Artificial Sequence: Synthetic oligonucleotide
  Target: FXN; (+) strand; PAM type: YTN; PAM sequence: CTT
gacctgccatgtgtaggaag

SEQ ID NO: 32633 - DNA, 20 bp, Artificial Sequence
  Description of Artificial Sequence: Synthetic oligonucleotide
  Target: FXN; (+) strand; PAM type: YTN; PAM sequence: TTG
acctgccatgtgtaggaaga

SEQ ID NO: 32634 - DNA, 20 bp, Artificial Sequence
  Description of Artificial Sequence: Synthetic oligonucleotide
  Target: FXN; (+) strand; PAM type: YTN; PAM sequence: CTG
ccatgtgtaggaagacagcc

SEQ ID NO: 32635 - DNA, 20 bp, Artificial Sequence
  Description of Artificial Sequence: Synthetic oligonucleotide
  Target: FXN; (+) strand; PAM type: YTN; PAM sequence: CTT
ctgccagggcccaactctgc

SEQ ID NO: 32636 - DNA, 20 bp, Artificial Sequence
  Description of Artificial Sequence: Synthetic oligonucleotide
  Target: FXN; (+) strand; PAM type: YTN; PAM sequence: TTC
tgccagggcccaactctgcc

SEQ ID NO: 32637 - DNA, 20 bp, Artificial Sequence
  Description of Artificial Sequence: Synthetic oligonucleotide
  Target: FXN; (+) strand; PAM type: YTN; PAM sequence: CTG
ccagggcccaactctgccgg

SEQ ID NO: 32638 - DNA, 20 bp, Artificial Sequence
  Description of Artificial Sequence: Synthetic oligonucleotide
  Target: FXN; (+) strand; PAM type: YTN; PAM sequence: CTC
tgccggcaggtagcaccttc

SEQ ID NO: 32639 - DNA, 20 bp, Artificial Sequence
  Description of Artificial Sequence: Synthetic oligonucleotide
  Target: FXN; (+) strand; PAM type: YTN; PAM sequence: CTG
ccggcaggtagcaccttcca

SEQ ID NO: 32640 - DNA, 20 bp, Artificial Sequence
  Description of Artificial Sequence: Synthetic oligonucleotide
  Target: FXN; (+) strand; PAM type: YTN; PAM sequence: CTT
ccaacctcttcactttggac

SEQ ID NO: 32641 - DNA, 20 bp, Artificial Sequence
  Description of Artificial Sequence: Synthetic oligonucleotide
  Target: FXN; (+) strand; PAM type: YTN; PAM sequence: TTC
caacctcttcactttggact

SEQ ID NO: 32642 - DNA, 20 bp, Artificial Sequence
  Description of Artificial Sequence: Synthetic oligonucleotide
  Target: FXN; (+) strand; PAM type: YTN; PAM sequence: CTC
ttcactttggactttataac

SEQ ID NO: 32643 - DNA, 20 bp, Artificial Sequence
  Description of Artificial Sequence: Synthetic oligonucleotide
  Target: FXN; (+) strand; PAM type: YTN; PAM sequence: CTT
cactttggactttataactg

SEQ ID NO: 32644 - DNA, 20 bp, Artificial Sequence
  Description of Artificial Sequence: Synthetic oligonucleotide
  Target: FXN; (+) strand; PAM type: YTN; PAM sequence: TTC
actttggactttataactgt

SEQ ID NO: 32645 - DNA, 20 bp, Artificial Sequence
  Description of Artificial Sequence: Synthetic oligonucleotide
  Target: FXN; (+) strand; PAM type: YTN; PAM sequence: CTT
tggactttataactgtcagg

SEQ ID NO: 32646 - DNA, 20 bp, Artificial Sequence
  Description of Artificial Sequence: Synthetic oligonucleotide
  Target: FXN; (+) strand; PAM type: YTN; PAM sequence: TTT
ggactttataactgtcaggt

SEQ ID NO: 32647 - DNA, 20 bp, Artificial Sequence
  Description of Artificial Sequence: Synthetic oligonucleotide
  Target: FXN; (+) strand; PAM type: YTN; PAM sequence: TTG
gactttataactgtcaggta

SEQ ID NO: 32648 - DNA, 20 bp, Artificial Sequence
  Description of Artificial Sequence: Synthetic oligonucleotide
  Target: FXN; (+) strand; PAM type: YTN; PAM sequence: CTT
tataactgtcaggtataaag

SEQ ID NO: 32649 - DNA, 20 bp, Artificial Sequence
  Description of Artificial Sequence: Synthetic oligonucleotide
  Target: FXN; (+) strand; PAM type: YTN; PAM sequence: TTT
ataactgtcaggtataaagt

SEQ ID NO: 32650 - DNA, 20 bp, Artificial Sequence
  Description of Artificial Sequence: Synthetic oligonucleotide
  Target: FXN; (+) strand; PAM type: YTN; PAM sequence: TTA
taactgtcaggtataaagtc

SEQ ID NO: 32651 - DNA, 20 bp, Artificial Sequence
  Description of Artificial Sequence: Synthetic oligonucleotide
  Target: FXN; (+) strand; PAM type: YTN; PAM sequence: CTG
tcaggtataaagtcggttgt

SEQ ID NO: 32652 - DNA, 20 bp, Artificial Sequence
  Description of Artificial Sequence: Synthetic oligonucleotide
  Target: FXN; (+) strand; PAM type: YTN; PAM sequence: TTG
tgtccttacgtttctcaaat

SEQ ID NO: 32653 - DNA, 20 bp, Artificial Sequence
  Description of Artificial Sequence: Synthetic oligonucleotide
  Target: FXN; (+) strand; PAM type: YTN; PAM sequence: CTT
acgtttctcaaattcttcaa

SEQ ID NO: 32654 - DNA, 20 bp, Artificial Sequence
  Description of Artificial Sequence: Synthetic oligonucleotide
  Target: FXN; (+) strand; PAM type: YTN; PAM sequence: TTA
cgtttctcaaattcttcaag

SEQ ID NO: 32655 - DNA, 20 bp, Artificial Sequence
  Description of Artificial Sequence: Synthetic oligonucleotide
  Target: FXN; (+) strand; PAM type: YTN; PAM sequence: TTT
ctcaaattcttcaagacacg

SEQ ID NO: 32656 - DNA, 20 bp, Artificial Sequence
  Description of Artificial Sequence: Synthetic oligonucleotide
  Target: FXN; (+) strand; PAM type: YTN; PAM sequence: TTC
tcaaattcttcaagacacgt

SEQ ID NO: 32657 - DNA, 20 bp, Artificial Sequence
  Description of Artificial Sequence: Synthetic oligonucleotide
  Target: FXN; (+) strand; PAM type: YTN; PAM sequence: CTC
aaattcttcaagacacgtca

SEQ ID NO: 32658 - DNA, 20 bp, Artificial Sequence
  Description of Artificial Sequence: Synthetic oligonucleotide
  Target: FXN; (+) strand; PAM type: YTN; PAM sequence: TTC
ttcaagacacgtcaaccagc

SEQ ID NO: 32659 - DNA, 20 bp, Artificial Sequence
  Description of Artificial Sequence: Synthetic oligonucleotide
  Target: FXN; (+) strand; PAM type: YTN; PAM sequence: CTT
caagacacgtcaaccagcct

SEQ ID NO: 32660 - DNA, 20 bp, Artificial Sequence
  Description of Artificial Sequence: Synthetic oligonucleotide
  Target: FXN; (+) strand; PAM type: YTN; PAM sequence: TTC
aagacacgtcaaccagcctc

SEQ ID NO: 32661 - DNA, 20 bp, Artificial Sequence
  Description of Artificial Sequence: Synthetic oligonucleotide
  Target: FXN; (+) strand; PAM type: YTN; PAM sequence: CTC
tcctacgcattctctccagc

SEQ ID NO: 32662 - DNA, 20 bp, Artificial Sequence
  Description of Artificial Sequence: Synthetic oligonucleotide
  Target: FXN; (+) strand; PAM type: YTN; PAM sequence: CTC
ctacgcattctctccagctc

SEQ ID NO: 32663 - DNA, 20 bp, Artificial Sequence
  Description of Artificial Sequence: Synthetic oligonucleotide
  Target: FXN; (+) strand; PAM type: YTN; PAM sequence: CTA
cgcattctctccagctcagt

SEQ ID NO: 32664 - DNA, 20 bp, Artificial Sequence
  Description of Artificial Sequence: Synthetic oligonucleotide
  Target: FXN; (+) strand; PAM type: YTN; PAM sequence: TTC
tctccagctcagtctcaaaa

SEQ ID NO: 32665 - DNA, 20 bp, Artificial Sequence
  Description of Artificial Sequence: Synthetic oligonucleotide
  Target: FXN; (+) strand; PAM type: YTN; PAM sequence: CTC
tccagctcagtctcaaaaca

SEQ ID NO: 32666 - DNA, 20 bp, Artificial Sequence
  Description of Artificial Sequence: Synthetic oligonucleotide
  Target: FXN; (+) strand; PAM type: YTN; PAM sequence: CTC
cagctcagtctcaaaacaca

SEQ ID NO: 32667 - DNA, 20 bp, Artificial Sequence
  Description of Artificial Sequence: Synthetic oligonucleotide
  Target: FXN; (+) strand; PAM type: YTN; PAM sequence: CTC
agtctcaaaacacacccttt

SEQ ID NO: 32668 - DNA, 20 bp, Artificial Sequence
  Description of Artificial Sequence: Synthetic oligonucleotide
  Target: FXN; (+) strand; PAM type: YTN; PAM sequence: CTC
aaaacacaccctttctctcc

SEQ ID NO: 32669 - DNA, 20 bp, Artificial Sequence
  Description of Artificial Sequence: Synthetic oligonucleotide
  Target: FXN; (+) strand; PAM type: YTN; PAM sequence: CTT
tctctccagctcactctcaa

SEQ ID NO: 32670 - DNA, 20 bp, Artificial Sequence
  Description of Artificial Sequence: Synthetic oligonucleotide
  Target: FXN; (+) strand; PAM type: YTN; PAM sequence: TTT
ctctccagctcactctcaaa

SEQ ID NO: 32671 - DNA, 20 bp, Artificial Sequence
  Description of Artificial Sequence: Synthetic oligonucleotide
  Target: FXN; (+) strand; PAM type: YTN; PAM sequence: TTC
tctccagctcactctcaaaa

SEQ ID NO: 32672 - DNA, 20 bp, Artificial Sequence
  Description of Artificial Sequence: Synthetic oligonucleotide
  Target: FXN; (+) strand; PAM type: YTN; PAM sequence: CTC
tccagctcactctcaaaaca

SEQ ID NO: 32673 - DNA, 20 bp, Artificial Sequence
  Description of Artificial Sequence: Synthetic oligonucleotide
  Target: FXN; (+) strand; PAM type: YTN; PAM sequence: CTC
cagctcactctcaaaacaca

SEQ ID NO: 32674 - DNA, 20 bp, Artificial Sequence
  Description of Artificial Sequence: Synthetic oligonucleotide
  Target: FXN; (+) strand; PAM type: YTN; PAM sequence: CTC
actctcaaaacacaccctat

SEQ ID NO: 32675 - DNA, 20 bp, Artificial Sequence
  Description of Artificial Sequence: Synthetic oligonucleotide
  Target: FXN; (+) strand; PAM type: YTN; PAM sequence: CTC
tcaaaacacaccctatcagg

SEQ ID NO: 32676 - DNA, 20 bp, Artificial Sequence
  Description of Artificial Sequence: Synthetic oligonucleotide
  Target: FXN; (+) strand; PAM type: YTN; PAM sequence: CTC
aaaacacaccctatcaggcc

SEQ ID NO: 32677 - DNA, 20 bp, Artificial Sequence
  Description of Artificial Sequence: Synthetic oligonucleotide
  Target: FXN; (+) strand; PAM type: YTN; PAM sequence: CTA
tcaggccaaccactcttttt

SEQ ID NO: 32678 - DNA, 20 bp, Artificial Sequence
  Description of Artificial Sequence: Synthetic oligonucleotide
  Target: FXN; (+) strand; PAM type: YTN; PAM sequence: CTC
tttttaaaggacagctcctc

SEQ ID NO: 32679 - DNA, 20 bp, Artificial Sequence
  Description of Artificial Sequence: Synthetic oligonucleotide
  Target: FXN; (+) strand; PAM type: YTN; PAM sequence: CTT
tttaaaggacagctcctcac

SEQ ID NO: 32680 - DNA, 20 bp, Artificial Sequence
  Description of Artificial Sequence: Synthetic oligonucleotide
  Target: FXN; (+) strand; PAM type: YTN; PAM sequence: TTT
ttaaaggacagctcctcacc

SEQ ID NO: 32681 - DNA, 20 bp, Artificial Sequence
  Description of Artificial Sequence: Synthetic oligonucleotide
  Target: FXN; (+) strand; PAM type: YTN; PAM sequence: TTT
taaaggacagctcctcacca

SEQ ID NO: 32682 - DNA, 20 bp, Artificial Sequence
  Description of Artificial Sequence: Synthetic oligonucleotide
  Target: FXN; (+) strand; PAM type: YTN; PAM sequence: TTT
aaaggacagctcctcaccaa

SEQ ID NO: 32683 - DNA, 20 bp, Artificial Sequence
  Description of Artificial Sequence: Synthetic oligonucleotide
  Target: FXN; (+) strand; PAM type: YTN; PAM sequence: TTA
aaggacagctcctcaccaat

SEQ ID NO: 32684 - DNA, 20 bp, Artificial Sequence
  Description of Artificial Sequence: Synthetic oligonucleotide
  Target: FXN; (+) strand; PAM type: YTN; PAM sequence: CTC
ctcaccaatccagtcaggta

SEQ ID NO: 32685 - DNA, 20 bp, Artificial Sequence
  Description of Artificial Sequence: Synthetic oligonucleotide
  Target: FXN; (+) strand; PAM type: YTN; PAM sequence: CTC
accaatccagtcaggtagcc

SEQ ID NO: 32686 - DNA, 20 bp, Artificial Sequence
  Description of Artificial Sequence: Synthetic oligonucleotide
  Target: FXN; (+) strand; PAM type: YTN; PAM sequence: CTT
ccccacattgtatcctggaa

SEQ ID NO: 32687 - DNA, 20 bp, Artificial Sequence
  Description of Artificial Sequence: Synthetic oligonucleotide
  Target: FXN; (+) strand; PAM type: YTN; PAM sequence: TTC
cccacattgtatcctggaag

SEQ ID NO: 32688 - DNA, 20 bp, Artificial Sequence
  Description of Artificial Sequence: Synthetic oligonucleotide
  Target: FXN; (+) strand; PAM type: YTN; PAM sequence: TTG
tatcctggaagtgggtgatg

SEQ ID NO: 32689 - DNA, 20 bp, Artificial Sequence
  Description of Artificial Sequence: Synthetic oligonucleotide
  Target: FXN; (+) strand; PAM type: YTN; PAM sequence: CTG
gaagtgggtgatggactggg

SEQ ID NO: 32690 - DNA, 20 bp, Artificial Sequence
  Description of Artificial Sequence: Synthetic oligonucleotide
  Target: FXN; (+) strand; PAM type: YTN; PAM sequence: CTG
ggtggggaagagggtcatat

SEQ ID NO: 32691 - DNA, 20 bp, Artificial Sequence
  Description of Artificial Sequence: Synthetic oligonucleotide
  Target: FXN; (+) strand; PAM type: YTN; PAM sequence: CTG
tatgtcttacagtaattgtc

SEQ ID NO: 32692 - DNA, 20 bp, Artificial Sequence
  Description of Artificial Sequence: Synthetic oligonucleotide
  Target: FXN; (+) strand; PAM type: YTN; PAM sequence: CTT
acagtaattgtctagcagcc

SEQ ID NO: 32693 - DNA, 20 bp, Artificial Sequence
  Description of Artificial Sequence: Synthetic oligonucleotide
  Target: FXN; (+) strand; PAM type: YTN; PAM sequence: TTA
cagtaattgtctagcagccc

SEQ ID NO: 32694 - DNA, 20 bp, Artificial Sequence
  Description of Artificial Sequence: Synthetic oligonucleotide
  Target: FXN; (+) strand; PAM type: YTN; PAM sequence: TTG
tctagcagcccctggtgtct

SEQ ID NO: 32695 - DNA, 20 bp, Artificial Sequence
  Description of Artificial Sequence: Synthetic oligonucleotide
  Target: FXN; (+) strand; PAM type: YTN; PAM sequence: CTA
gcagcccctggtgtcttact

SEQ ID NO: 32696 - DNA, 20 bp, Artificial Sequence
  Description of Artificial Sequence: Synthetic oligonucleotide
  Target: FXN; (+) strand; PAM type: YTN; PAM sequence: CTG
gtgtcttactttaggccccc

SEQ ID NO: 32697 - DNA, 20 bp, Artificial Sequence
  Description of Artificial Sequence: Synthetic oligonucleotide
  Target: FXN; (+) strand; PAM type: YTN; PAM sequence: CTT
actttaggccccctggaaac

SEQ ID NO: 32698 - DNA, 20 bp, Artificial Sequence
  Description of Artificial Sequence: Synthetic oligonucleotide
  Target: FXN; (+) strand; PAM type: YTN; PAM sequence: TTA
ctttaggccccctggaaact

SEQ ID NO: 32699 - DNA, 20 bp, Artificial Sequence
  Description of Artificial Sequence: Synthetic oligonucleotide
  Target: FXN; (+) strand; PAM type: YTN; PAM sequence: CTT
taggccccctggaaactttc

SEQ ID NO: 32700 - DNA, 20 bp, Artificial Sequence
  Description of Artificial Sequence: Synthetic oligonucleotide
  Target: FXN; (+) strand; PAM type: YTN; PAM sequence: TTT
aggccccctggaaactttca

SEQ ID NO: 32701 - DNA, 20 bp, Artificial Sequence
  Description of Artificial Sequence: Synthetic oligonucleotide
  Target: FXN; (+) strand; PAM type: YTN; PAM sequence: TTA
ggccccctggaaactttcag

SEQ ID NO: 32702 - DNA, 20 bp, Artificial Sequence
  Description of Artificial Sequence: Synthetic oligonucleotide
  Target: FXN; (+) strand; PAM type: YTN; PAM sequence: CTG
gaaactttcagatagtggag

SEQ ID NO: 32703 - DNA, 20 bp, Artificial Sequence
  Description of Artificial Sequence: Synthetic oligonucleotide
  Target: FXN; (+) strand; PAM type: YTN; PAM sequence: CTT
tcagatagtggagttgtctg

SEQ ID NO: 32704 - DNA, 20 bp, Artificial Sequence
  Description of Artificial Sequence: Synthetic oligonucleotide
  Target: FXN; (+) strand; PAM type: YTN; PAM sequence: TTT
cagatagtggagttgtctga

SEQ ID NO: 32705 - DNA, 20 bp, Artificial Sequence
  Description of Artificial Sequence: Synthetic oligonucleotide
  Target: FXN; (+) strand; PAM type: YTN; PAM sequence: TTC
agatagtggagttgtctgat

SEQ ID NO: 32706 - DNA, 20 bp, Artificial Sequence
  Description of Artificial Sequence: Synthetic oligonucleotide
  Target: FXN; (+) strand; PAM type: YTN; PAM sequence: TTG
tctgatacatatcttataac

SEQ ID NO: 32707 - DNA, 20 bp, Artificial Sequence
  Description of Artificial Sequence: Synthetic oligonucleotide
  Target: FXN; (+) strand; PAM type: YTN; PAM sequence: CTG
atacatatcttataacctac

SEQ ID NO: 32708 - DNA, 20 bp, Artificial Sequence
  Description of Artificial Sequence: Synthetic oligonucleotide
  Target: FXN; (+) strand; PAM type: YTN; PAM sequence: CTT
ataacctacagatattaata

SEQ ID NO: 32709 - DNA, 20 bp, Artificial Sequence
  Description of Artificial Sequence: Synthetic oligonucleotide
  Target: FXN; (+) strand; PAM type: YTN; PAM sequence: TTA
taacctacagatattaatat

SEQ ID NO: 32710 - DNA, 20 bp, Artificial Sequence
  Description of Artificial Sequence: Synthetic oligonucleotide
  Target: FXN; (+) strand; PAM type: YTN; PAM sequence: CTA
cagatattaatatatcctca

SEQ ID NO: 32711 - DNA, 20 bp, Artificial Sequence
  Description of Artificial Sequence: Synthetic oligonucleotide
  Target: FXN; (+) strand; PAM type: YTN; PAM sequence: TTA
atatatcctcacaggggcac

SEQ ID NO: 32712 - DNA, 20 bp, Artificial Sequence
  Description of Artificial Sequence: Synthetic oligonucleotide
  Target: FXN; (+) strand; PAM type: YTN; PAM sequence: CTC
acaggggcacaaaagctctt

SEQ ID NO: 32713 - DNA, 20 bp, Artificial Sequence
  Description of Artificial Sequence: Synthetic oligonucleotide
  Target: FXN; (+) strand; PAM type: YTN; PAM sequence: CTC
ttacaaggatgtttattata

SEQ ID NO: 32714 - DNA, 20 bp, Artificial Sequence
  Description of Artificial Sequence: Synthetic oligonucleotide
  Target: FXN; (+) strand; PAM type: YTN; PAM sequence: CTT
acaaggatgtttattataat

SEQ ID NO: 32715 - DNA, 20 bp, Artificial Sequence
  Description of Artificial Sequence: Synthetic oligonucleotide
  Target: FXN; (+) strand; PAM type: YTN; PAM sequence: TTA
caaggatgtttattataata

SEQ ID NO: 32716 - DNA, 20 bp, Artificial Sequence
  Description of Artificial Sequence: Synthetic oligonucleotide
  Target: FXN; (+) strand; PAM type: YTN; PAM sequence: TTT
attataataatatttttatt

SEQ ID NO: 32717 - DNA, 20 bp, Artificial Sequence
  Description of Artificial Sequence: Synthetic oligonucleotide
  Target: FXN; (+) strand; PAM type: YTN; PAM sequence: TTA
ttataataatatttttattg

SEQ ID NO: 32718 - DNA, 20 bp, Artificial Sequence
  Description of Artificial Sequence: Synthetic oligonucleotide
  Target: FXN; (+) strand; PAM type: YTN; PAM sequence: TTA
taataatatttttattgtta

SEQ ID NO: 32719 - DNA, 20 bp, Artificial Sequence
  Description of Artificial Sequence: Synthetic oligonucleotide
  Target: FXN; (+) strand; PAM type: YTN; PAM sequence: TTT
ttattgttataatttacatg

SEQ ID NO: 32720 - DNA, 20 bp, Artificial Sequence
  Description of Artificial Sequence: Synthetic oligonucleotide
  Target: FXN; (+) strand; PAM type: YTN; PAM sequence: TTT
tattgttataatttacatgc

SEQ ID NO: 32721 - DNA, 20 bp, Artificial Sequence
  Description of Artificial Sequence: Synthetic oligonucleotide
  Target: FXN; (+) strand; PAM type: YTN; PAM sequence: TTT
attgttataatttacatgcc

SEQ ID NO: 32722 - DNA, 20 bp, Artificial Sequence
  Description of Artificial Sequence: Synthetic oligonucleotide
  Target: FXN; (+) strand; PAM type: YTN; PAM sequence: TTA
ttgttataatttacatgcca

SEQ ID NO: 32723 - DNA, 20 bp, Artificial Sequence
  Description of Artificial Sequence: Synthetic oligonucleotide
  Target: FXN; (+) strand; PAM type: YTN; PAM sequence: TTG
ttataatttacatgccataa

SEQ ID NO: 32724 - DNA, 20 bp, Artificial Sequence
  Description of Artificial Sequence: Synthetic oligonucleotide
  Target: FXN; (+) strand; PAM type: YTN; PAM sequence: TTA
taatttacatgccataaaac

SEQ ID NO: 32725 - DNA, 20 bp, Artificial Sequence
  Description of Artificial Sequence: Synthetic oligonucleotide
  Target: FXN; (+) strand; PAM type: YTN; PAM sequence: TTT
acatgccataaaactaacca

SEQ ID NO: 32726 - DNA, 20 bp, Artificial Sequence
  Description of Artificial Sequence: Synthetic oligonucleotide
  Target: FXN; (+) strand; PAM type: YTN; PAM sequence: TTA
catgccataaaactaaccat

SEQ ID NO: 32727 - DNA, 20 bp, Artificial Sequence
  Description of Artificial Sequence: Synthetic oligonucleotide
  Target: FXN; (+) strand; PAM type: YTN; PAM sequence: CTA
accattttaaaatgtataat

SEQ ID NO: 32728 - DNA, 20 bp, Artificial Sequence
  Description of Artificial Sequence: Synthetic oligonucleotide
  Target: FXN; (+) strand; PAM type: YTN; PAM sequence: TTT
taaaatgtataatgcaaggg

SEQ ID NO: 32729 - DNA, 20 bp, Artificial Sequence
  Description of Artificial Sequence: Synthetic oligonucleotide
  Target: FXN; (+) strand; PAM type: YTN; PAM sequence: TTT
aaaatgtataatgcaagggt

SEQ ID NO: 32730 - DNA, 20 bp, Artificial Sequence
  Description of Artificial Sequence: Synthetic oligonucleotide
  Target: FXN; (+) strand; PAM type: YTN; PAM sequence: TTA
aaatgtataatgcaagggtt

SEQ ID NO: 32731 - DNA, 20 bp, Artificial Sequence
  Description of Artificial Sequence: Synthetic oligonucleotide
  Target: FXN; (+) strand; PAM type: YTN; PAM sequence: TTT
ttagtatattcacaagattg

SEQ ID NO: 32732 - DNA, 20 bp, Artificial Sequence
  Description of Artificial Sequence: Synthetic oligonucleotide
  Target: FXN; (+) strand; PAM type: YTN; PAM sequence: TTT
tagtatattcacaagattgt

SEQ ID NO: 32733 - DNA, 20 bp, Artificial Sequence
  Description of Artificial Sequence: Synthetic oligonucleotide
  Target: FXN; (+) strand; PAM type: YTN; PAM sequence: TTT
agtatattcacaagattgtg

SEQ ID NO: 32734 - DNA, 20 bp, Artificial Sequence
  Description of Artificial Sequence: Synthetic oligonucleotide
  Target: FXN; (+) strand; PAM type: YTN; PAM sequence: TTA
gtatattcacaagattgtgc

SEQ ID NO: 32735 - DNA, 20 bp, Artificial Sequence
  Description of Artificial Sequence: Synthetic oligonucleotide
  Target: FXN; (+) strand; PAM type: YTN; PAM sequence: TTC
acaagattgtgcagctgtca

SEQ ID NO: 32736 - DNA, 20 bp, Artificial Sequence
  Description of Artificial Sequence: Synthetic oligonucleotide
  Target: FXN; (+) strand; PAM type: YTN; PAM sequence: TTG
tgcagctgtcactactaatt

SEQ ID NO: 32737 - DNA, 20 bp, Artificial Sequence
  Description of Artificial Sequence: Synthetic oligonucleotide
  Target: FXN; (+) strand; PAM type: YTN; PAM sequence: CTG
tcactactaattccagaaca

SEQ ID NO: 32738 - DNA, 20 bp, Artificial Sequence
  Description of Artificial Sequence: Synthetic oligonucleotide
  Target: FXN; (+) strand; PAM type: YTN; PAM sequence: CTA
ctaattccagaacattttca

SEQ ID NO: 32739 - DNA, 20 bp, Artificial Sequence
  Description of Artificial Sequence: Synthetic oligonucleotide
  Target: FXN; (+) strand; PAM type: YTN; PAM sequence: CTA
attccagaacattttcatta

SEQ ID NO: 32740 - DNA, 20 bp, Artificial Sequence
  Description of Artificial Sequence: Synthetic oligonucleotide
  Target: FXN; (+) strand; PAM type: YTN; PAM sequence: TTC
cagaacattttcattattcc

SEQ ID NO: 32741 - DNA, 20 bp, Artificial Sequence
  Description of Artificial Sequence: Synthetic oligonucleotide
  Target: FXN; (+) strand; PAM type: YTN; PAM sequence: TTT
tcattattccagaaggaaac

SEQ ID NO: 32742 - DNA, 20 bp, Artificial Sequence
  Description of Artificial Sequence: Synthetic oligonucleotide
  Target: FXN; (+) strand; PAM type: YTN; PAM sequence: TTT
cattattccagaaggaaacc

SEQ ID NO: 32743 - DNA, 20 bp, Artificial Sequence
  Description of Artificial Sequence: Synthetic oligonucleotide
  Target: FXN; (+) strand; PAM type: YTN; PAM sequence: TTC
attattccagaaggaaaccc

SEQ ID NO: 32744 - DNA, 20 bp, Artificial Sequence
  Description of Artificial Sequence: Synthetic oligonucleotide
  Target: FXN; (+) strand; PAM type: YTN; PAM sequence: TTA
ttccagaaggaaaccctatt

SEQ ID NO: 32745 - DNA, 20 bp, Artificial Sequence
  Description of Artificial Sequence: Synthetic oligonucleotide
  Target: FXN; (+) strand; PAM type: YTN; PAM sequence: TTC
cagaaggaaaccctattcat

SEQ ID NO: 32746 - DNA, 20 bp, Artificial Sequence
  Description of Artificial Sequence: Synthetic oligonucleotide
  Target: FXN; (+) strand; PAM type: YTN; PAM sequence: CTA
ttcatattagcaatcactcc

SEQ ID NO: 32747 - DNA, 20 bp, Artificial Sequence
  Description of Artificial Sequence: Synthetic oligonucleotide
  Target: FXN; (+) strand; PAM type: YTN; PAM sequence: TTC
atattagcaatcactccccc

SEQ ID NO: 32748 - DNA, 20 bp, Artificial Sequence
  Description of Artificial Sequence: Synthetic oligonucleotide
  Target: FXN; (+) strand; PAM type: YTN; PAM sequence: TTA
gcaatcactcccccattccg

SEQ ID NO: 32749 - DNA, 20 bp, Artificial Sequence
  Description of Artificial Sequence: Synthetic oligonucleotide
  Target: FXN; (+) strand; PAM type: YTN; PAM sequence: CTC
ccccattccgcctttcccta

SEQ ID NO: 32750 - DNA, 20 bp, Artificial Sequence
  Description of Artificial Sequence: Synthetic oligonucleotide
  Target: FXN; (+) strand; PAM type: YTN; PAM sequence: TTC
cgcctttccctaaaacccag

SEQ ID NO: 32751 - DNA, 20 bp, Artificial Sequence
  Description of Artificial Sequence: Synthetic oligonucleotide
  Target: FXN; (+) strand; PAM type: YTN; PAM sequence: CTT
tccctaaaacccagcaatca

SEQ ID NO: 32752 - DNA, 20 bp, Artificial Sequence
  Description of Artificial Sequence: Synthetic oligonucleotide
  Target: FXN; (+) strand; PAM type: YTN; PAM sequence: TTT
ccctaaaacccagcaatcac

SEQ ID NO: 32753 - DNA, 20 bp, Artificial Sequence
  Description of Artificial Sequence: Synthetic oligonucleotide
  Target: FXN; (+) strand; PAM type: YTN; PAM sequence: TTC
cctaaaacccagcaatcact

SEQ ID NO: 32754 - DNA, 20 bp, Artificial Sequence
  Description of Artificial Sequence: Synthetic oligonucleotide
  Target: FXN; (+) strand; PAM type: YTN; PAM sequence: CTA
aaacccagcaatcactaatc

SEQ ID NO: 32755 - DNA, 20 bp, Artificial Sequence
  Description of Artificial Sequence: Synthetic oligonucleotide
  Target: FXN; (+) strand; PAM type: YTN; PAM sequence: CTA
atctactttctgtctctgtg

SEQ ID NO: 32756 - DNA, 20 bp, Artificial Sequence
  Description of Artificial Sequence: Synthetic oligonucleotide
  Target: FXN; (+) strand; PAM type: YTN; PAM sequence: CTA
ctttctgtctctgtggattt

SEQ ID NO: 32757 - DNA, 20 bp, Artificial Sequence
  Description of Artificial Sequence: Synthetic oligonucleotide
  Target: FXN; (+) strand; PAM type: YTN; PAM sequence: CTT
tctgtctctgtggatttaaa

SEQ ID NO: 32758 - DNA, 20 bp, Artificial Sequence
  Description of Artificial Sequence: Synthetic oligonucleotide
  Target: FXN; (+) strand; PAM type: YTN; PAM sequence: TTT
ctgtctctgtggatttaaag

SEQ ID NO: 32759 - DNA, 20 bp, Artificial Sequence
  Description of Artificial Sequence: Synthetic oligonucleotide
  Target: FXN; (+) strand; PAM type: YTN; PAM sequence: TTC
tgtctctgtggatttaaagt

SEQ ID NO: 32760 - DNA, 20 bp, Artificial Sequence
  Description of Artificial Sequence: Synthetic oligonucleotide
  Target: FXN; (+) strand; PAM type: YTN; PAM sequence: CTG
tctctgtggatttaaagtaa

SEQ ID NO: 32761 - DNA, 20 bp, Artificial Sequence
  Description of Artificial Sequence: Synthetic oligonucleotide
  Target: FXN; (+) strand; PAM type: YTN; PAM sequence: CTC
tgtggatttaaagtaatttt

SEQ ID NO: 32762 - DNA, 20 bp, Artificial Sequence
  Description of Artificial Sequence: Synthetic oligonucleotide
  Target: FXN; (+) strand; PAM type: YTN; PAM sequence: CTG
tggatttaaagtaattttaa

SEQ ID NO: 32763 - DNA, 20 bp, Artificial Sequence
  Description of Artificial Sequence: Synthetic oligonucleotide
  Target: FXN; (+) strand; PAM type: YTN; PAM sequence: TTT
aaagtaattttaaatttgaa

SEQ ID NO: 32764 - DNA, 20 bp, Artificial Sequence
  Description of Artificial Sequence: Synthetic oligonucleotide
  Target: FXN; (+) strand; PAM type: YTN; PAM sequence: TTA
aagtaattttaaatttgaaa

SEQ ID NO: 32765 - DNA, 20 bp, Artificial Sequence
  Description of Artificial Sequence: Synthetic oligonucleotide
  Target: FXN; (+) strand; PAM type: YTN; PAM sequence: TTT
taaatttgaaaaatagtatc

SEQ ID NO: 32766 - DNA, 20 bp, Artificial Sequence
  Description of Artificial Sequence: Synthetic oligonucleotide
  Target: FXN; (+) strand; PAM type: YTN; PAM sequence: TTT
aaatttgaaaaatagtatct

SEQ ID NO: 32767 - DNA, 20 bp, Artificial Sequence
  Description of Artificial Sequence: Synthetic oligonucleotide
  Target: FXN; (+) strand; PAM type: YTN; PAM sequence: TTA
aatttgaaaaatagtatcta

SEQ ID NO: 32768 - DNA, 20 bp, Artificial Sequence
  Description of Artificial Sequence: Synthetic oligonucleotide
  Target: FXN; (+) strand; PAM type: YTN; PAM sequence: TTT
gaaaaatagtatctataagg

SEQ ID NO: 32769 - DNA, 20 bp, Artificial Sequence
  Description of Artificial Sequence: Synthetic oligonucleotide
  Target: FXN; (+) strand; PAM type: YTN; PAM sequence: TTG
aaaaatagtatctataagga

SEQ ID NO: 32770 - DNA, 20 bp, Artificial Sequence
  Description of Artificial Sequence: Synthetic oligonucleotide
  Target: FXN; (+) strand; PAM type: YTN; PAM sequence: CTA
taaggaaatgtatctagtca

SEQ ID NO: 32771 - DNA, 20 bp, Artificial Sequence
  Description of Artificial Sequence: Synthetic oligonucleotide
  Target: FXN; (+) strand; PAM type: YTN; PAM sequence: CTA
gtcacaagcatacagcttga

SEQ ID NO: 32772 - DNA, 20 bp, Artificial Sequence
  Description of Artificial Sequence: Synthetic oligonucleotide
  Target: FXN; (+) strand; PAM type: YTN; PAM sequence: CTT
gatgaatttgtaaaaattga

SEQ ID NO: 32773 - DNA, 20 bp, Artificial Sequence
  Description of Artificial Sequence: Synthetic oligonucleotide
  Target: FXN; (+) strand; PAM type: YTN; PAM sequence: TTG
atgaatttgtaaaaattgaa

SEQ ID NO: 32774 - DNA, 20 bp, Artificial Sequence
  Description of Artificial Sequence: Synthetic oligonucleotide
  Target: FXN; (+) strand; PAM type: YTN; PAM sequence: TTT
gtaaaaattgaacagtccta

SEQ ID NO: 32775 - DNA, 20 bp, Artificial Sequence
  Description of Artificial Sequence: Synthetic oligonucleotide
  Target: FXN; (+) strand; PAM type: YTN; PAM sequence: TTG
taaaaattgaacagtcctat

SEQ ID NO: 32776 - DNA, 20 bp, Artificial Sequence
  Description of Artificial Sequence: Synthetic oligonucleotide
  Target: FXN; (+) strand; PAM type: YTN; PAM sequence: TTG
aacagtcctatgaacatacc

SEQ ID NO: 32777 - DNA, 20 bp, Artificial Sequence
  Description of Artificial Sequence: Synthetic oligonucleotide
  Target: FXN; (+) strand; PAM type: YTN; PAM sequence: CTA
tgaacataccctgtaagctc

SEQ ID NO: 32778 - DNA, 20 bp, Artificial Sequence
  Description of Artificial Sequence: Synthetic oligonucleotide
  Target: FXN; (+) strand; PAM type: YTN; PAM sequence: CTG
taagctcaagacatagaatg

SEQ ID NO: 32779 - DNA, 20 bp, Artificial Sequence
  Description of Artificial Sequence: Synthetic oligonucleotide
  Target: FXN; (+) strand; PAM type: YTN; PAM sequence: CTC
aagacatagaatgttaccag

SEQ ID NO: 32780 - DNA, 20 bp, Artificial Sequence
  Description of Artificial Sequence: Synthetic oligonucleotide
  Target: FXN; (+) strand; PAM type: YTN; PAM sequence: TTA
ccagcccctgcaagcaagct

SEQ ID NO: 32781 - DNA, 20 bp, Artificial Sequence
  Description of Artificial Sequence: Synthetic oligonucleotide
  Target: FXN; (+) strand; PAM type: YTN; PAM sequence: CTG
caagcaagctgcctgctcac

SEQ ID NO: 32782 - DNA, 20 bp, Artificial Sequence
  Description of Artificial Sequence: Synthetic oligonucleotide
  Target: FXN; (+) strand; PAM type: YTN; PAM sequence: CTG
cctgctcacttctagtcatt

SEQ ID NO: 32783 - DNA, 20 bp, Artificial Sequence
  Description of Artificial Sequence: Synthetic oligonucleotide
  Target: FXN; (+) strand; PAM type: YTN; PAM sequence: CTG
ctcacttctagtcattaacc

SEQ ID NO: 32784 - DNA, 20 bp, Artificial Sequence
  Description of Artificial Sequence: Synthetic oligonucleotide
  Target: FXN; (+) strand; PAM type: YTN; PAM sequence: CTC
acttctagtcattaacccct

SEQ ID NO: 32785 - DNA, 20 bp, Artificial Sequence
  Description of Artificial Sequence: Synthetic oligonucleotide
  Target: FXN; (+) strand; PAM type: YTN; PAM sequence: CTT
ctagtcattaacccctccct

SEQ ID NO: 32786 - DNA, 20 bp, Artificial Sequence
  Description of Artificial Sequence: Synthetic oligonucleotide
  Target: FXN; (+) strand; PAM type: YTN; PAM sequence: TTC
tagtcattaacccctccctc

SEQ ID NO: 32787 - DNA, 20 bp, Artificial Sequence
  Description of Artificial Sequence: Synthetic oligonucleotide
  Target: FXN; (+) strand; PAM type: YTN; PAM sequence: CTA
gtcattaacccctccctctt

SEQ ID NO: 32788 - DNA, 20 bp, Artificial Sequence
  Description of Artificial Sequence: Synthetic oligonucleotide
  Target: FXN; (+) strand; PAM type: YTN; PAM sequence: TTA
acccctccctcttttccttc

SEQ ID NO: 32789 - DNA, 20 bp, Artificial Sequence
  Description of Artificial Sequence: Synthetic oligonucleotide
  Target: FXN; (+) strand; PAM type: YTN; PAM sequence: CTC
cctcttttccttctagtcat

SEQ ID NO: 32790 - DNA, 20 bp, Artificial Sequence
  Description of Artificial Sequence: Synthetic oligonucleotide
  Target: FXN; (+) strand; PAM type: YTN; PAM sequence: CTC
ttttccttctagtcattaac

SEQ ID NO: 32791 - DNA, 20 bp, Artificial Sequence
  Description of Artificial Sequence: Synthetic oligonucleotide
  Target: FXN; (+) strand; PAM type: YTN; PAM sequence: CTT
ttccttctagtcattaaccc

SEQ ID NO: 32792 - DNA, 20 bp, Artificial Sequence
  Description of Artificial Sequence: Synthetic oligonucleotide
  Target: FXN; (+) strand; PAM type: YTN; PAM sequence: TTT
tccttctagtcattaaccct

SEQ ID NO: 32793 - DNA, 20 bp, Artificial Sequence
  Description of Artificial Sequence: Synthetic oligonucleotide
  Target: FXN; (+) strand; PAM type: YTN; PAM sequence: TTT
ccttctagtcattaaccctt

SEQ ID NO: 32794 - DNA, 20 bp, Artificial Sequence
  Description of Artificial Sequence: Synthetic oligonucleotide
  Target: FXN; (+) strand; PAM type: YTN; PAM sequence: TTC
cttctagtcattaacccttc

SEQ ID NO: 32795 - DNA, 20 bp, Artificial Sequence
  Description of Artificial Sequence: Synthetic oligonucleotide
  Target: FXN; (+) strand; PAM type: YTN; PAM sequence: CTT
ctagtcattaacccttcaga

SEQ ID NO: 32796 - DNA, 20 bp, Artificial Sequence
  Description of Artificial Sequence: Synthetic oligonucleotide
  Target: FXN; (+) strand; PAM type: YTN; PAM sequence: TTC
tagtcattaacccttcagag

SEQ ID NO: 32797 - DNA, 20 bp, Artificial Sequence
  Description of Artificial Sequence: Synthetic oligonucleotide
  Target: FXN; (+) strand; PAM type: YTN; PAM sequence: CTA
gtcattaacccttcagagta

SEQ ID NO: 32798 - DNA, 20 bp, Artificial Sequence
  Description of Artificial Sequence: Synthetic oligonucleotide
  Target: FXN; (+) strand; PAM type: YTN; PAM sequence: TTA
acccttcagagtaactattc

SEQ ID NO: 32799 - DNA, 20 bp, Artificial Sequence
  Description of Artificial Sequence: Synthetic oligonucleotide
  Target: FXN; (+) strand; PAM type: YTN; PAM sequence: CTT
cagagtaactattctgatta

SEQ ID NO: 32800 - DNA, 20 bp, Artificial Sequence
  Description of Artificial Sequence: Synthetic oligonucleotide
  Target: FXN; (+) strand; PAM type: YTN; PAM sequence: TTC
agagtaactattctgattac

SEQ ID NO: 32801 - DNA, 20 bp, Artificial Sequence
  Description of Artificial Sequence: Synthetic oligonucleotide
  Target: FXN; (+) strand; PAM type: YTN; PAM sequence: CTA
ttctgattaccaatagcata

SEQ ID NO: 32802 - DNA, 20 bp, Artificial Sequence
  Description of Artificial Sequence: Synthetic oligonucleotide
  Target: FXN; (+) strand; PAM type: YTN; PAM sequence: TTC
tgattaccaatagcatagat

SEQ ID NO: 32803 - DNA, 20 bp, Artificial Sequence
  Description of Artificial Sequence: Synthetic oligonucleotide
  Target: FXN; (+) strand; PAM type: YTN; PAM sequence: CTG
attaccaatagcatagatta

SEQ ID NO: 32804 - DNA, 20 bp, Artificial Sequence
  Description of Artificial Sequence: Synthetic oligonucleotide
  Target: FXN; (+) strand; PAM type: YTN; PAM sequence: TTA
ccaatagcatagattagttc

SEQ ID NO: 32805 - DNA, 20 bp, Artificial Sequence
  Description of Artificial Sequence: Synthetic oligonucleotide
  Target: FXN; (+) strand; PAM type: YTN; PAM sequence: TTA
gttctgcctgttgttttact

SEQ ID NO: 32806 - DNA, 20 bp, Artificial Sequence
  Description of Artificial Sequence: Synthetic oligonucleotide
  Target: FXN; (+) strand; PAM type: YTN; PAM sequence: TTC
tgcctgttgttttactttat

SEQ ID NO: 32807 - DNA, 20 bp, Artificial Sequence
  Description of Artificial Sequence: Synthetic oligonucleotide
  Target: FXN; (+) strand; PAM type: YTN; PAM sequence: CTG
cctgttgttttactttatat

SEQ ID NO: 32808 - DNA, 20 bp, Artificial Sequence
  Description of Artificial Sequence: Synthetic oligonucleotide
  Target: FXN; (+) strand; PAM type: YTN; PAM sequence: CTG
ttgttttactttatataaac

SEQ ID NO: 32809 - DNA, 20 bp, Artificial Sequence
  Description of Artificial Sequence: Synthetic oligonucleotide
  Target: FXN; (+) strand; PAM type: YTN; PAM sequence: TTG
ttttactttatataaactgt

SEQ ID NO: 32810 - DNA, 20 bp, Artificial Sequence
  Description of Artificial Sequence: Synthetic oligonucleotide
  Target: FXN; (+) strand; PAM type: YTN; PAM sequence: TTT
tactttatataaactgtctc

SEQ ID NO: 32811 - DNA, 20 bp, Artificial Sequence
  Description of Artificial Sequence: Synthetic oligonucleotide
  Target: FXN; (+) strand; PAM type: YTN; PAM sequence: TTT
actttatataaactgtctca

SEQ ID NO: 32812 - DNA, 20 bp, Artificial Sequence
  Description of Artificial Sequence: Synthetic oligonucleotide
  Target: FXN; (+) strand; PAM type: YTN; PAM sequence: TTA
ctttatataaactgtctcat

SEQ ID NO: 32813 - DNA, 20 bp, Artificial Sequence
  Description of Artificial Sequence: Synthetic oligonucleotide
  Target: FXN; (+) strand; PAM type: YTN; PAM sequence: CTT
tatataaactgtctcattaa

SEQ ID NO: 32814 - DNA, 20 bp, Artificial Sequence
  Description of Artificial Sequence: Synthetic oligonucleotide
  Target: FXN; (+) strand; PAM type: YTN; PAM sequence: TTT
atataaactgtctcattaag

SEQ ID NO: 32815 - DNA, 20 bp, Artificial Sequence
  Description of Artificial Sequence: Synthetic oligonucleotide
  Target: FXN; (+) strand; PAM type: YTN; PAM sequence: TTA
tataaactgtctcattaagt

SEQ ID NO: 32816 - DNA, 20 bp, Artificial Sequence
  Description of Artificial Sequence: Synthetic oligonucleotide
  Target: FXN; (+) strand; PAM type: YTN; PAM sequence: CTG
tctcattaagtataaacatg

SEQ ID NO: 32817 - DNA, 20 bp, Artificial Sequence
  Description of Artificial Sequence: Synthetic oligonucleotide
  Target: FXN; (+) strand; PAM type: YTN; PAM sequence: CTC
attaagtataaacatgtttg

SEQ ID NO: 32818 - DNA, 20 bp, Artificial Sequence
  Description of Artificial Sequence: Synthetic oligonucleotide
  Target: FXN; (+) strand; PAM type: YTN; PAM sequence: TTA
agtataaacatgtttgtgta

SEQ ID NO: 32819 - DNA, 20 bp, Artificial Sequence
  Description of Artificial Sequence: Synthetic oligonucleotide
  Target: FXN; (+) strand; PAM type: YTN; PAM sequence: TTT
gtgtatacttgtgtatttct

SEQ ID NO: 32820 - DNA, 20 bp, Artificial Sequence
  Description of Artificial Sequence: Synthetic oligonucleotide
  Target: FXN; (+) strand; PAM type: YTN; PAM sequence: TTG
tgtatacttgtgtatttctt

SEQ ID NO: 32821 - DNA, 20 bp, Artificial Sequence
  Description of Artificial Sequence: Synthetic oligonucleotide
  Target: FXN; (+) strand; PAM type: YTN; PAM sequence: CTT
gtgtatttctttctatcaca

SEQ ID NO: 32822 - DNA, 20 bp, Artificial Sequence
  Description of Artificial Sequence: Synthetic oligonucleotide
  Target: FXN; (+) strand; PAM type: YTN; PAM sequence: TTG
tgtatttctttctatcacaa

SEQ ID NO: 32823 - DNA, 20 bp, Artificial Sequence
  Description of Artificial Sequence: Synthetic oligonucleotide
  Target: FXN; (+) strand; PAM type: YTN; PAM sequence: TTT
ctttctatcacaatgatgtt

SEQ ID NO: 32824 - DNA, 20 bp, Artificial Sequence
  Description of Artificial Sequence: Synthetic oligonucleotide
  Target: FXN; (+) strand; PAM type: YTN; PAM sequence: TTC
tttctatcacaatgatgttt

SEQ ID NO: 32825 - DNA, 20 bp, Artificial Sequence
  Description of Artificial Sequence: Synthetic oligonucleotide
  Target: FXN; (+) strand; PAM type: YTN; PAM sequence: CTT
tctatcacaatgatgtttgt

SEQ ID NO: 32826 - DNA, 20 bp, Artificial Sequence
  Description of Artificial Sequence: Synthetic oligonucleotide
  Target: FXN; (+) strand; PAM type: YTN; PAM sequence: TTT
ctatcacaatgatgtttgtg

SEQ ID NO: 32827 - DNA, 20 bp, Artificial Sequence
  Description of Artificial Sequence: Synthetic oligonucleotide
  Target: FXN; (+) strand; PAM type: YTN; PAM sequence: TTC
tatcacaatgatgtttgtga

SEQ ID NO: 32828 - DNA, 20 bp, Artificial Sequence
  Description of Artificial Sequence: Synthetic oligonucleotide
  Target: FXN; (+) strand; PAM type: YTN; PAM sequence: CTA
tcacaatgatgtttgtgaga

SEQ ID NO: 32829 - DNA, 20 bp, Artificial Sequence
  Description of Artificial Sequence: Synthetic oligonucleotide
  Target: FXN; (+) strand; PAM type: YTN; PAM sequence: TTT
gtgagattcatccatgctgt

SEQ ID NO: 32830 - DNA, 20 bp, Artificial Sequence
  Description of Artificial Sequence: Synthetic oligonucleotide
  Target: FXN; (+) strand; PAM type: YTN; PAM sequence: TTG
tgagattcatccatgctgtt

SEQ ID NO: 32831 - DNA, 20 bp, Artificial Sequence
  Description of Artificial Sequence: Synthetic oligonucleotide
  Target: FXN; (+) strand; PAM type: YTN; PAM sequence: TTC
atccatgctgttcctataga

SEQ ID NO: 32832 - DNA, 20 bp, Artificial Sequence
  Description of Artificial Sequence: Synthetic oligonucleotide
  Target: FXN; (+) strand; PAM type: YTN; PAM sequence: CTG
ttcctatagacaattctatt

SEQ ID NO: 32833 - DNA, 20 bp, Artificial Sequence
  Description of Artificial Sequence: Synthetic oligonucleotide
  Target: FXN; (+) strand; PAM type: YTN; PAM sequence: TTC
ctatagacaattctattttg

SEQ ID NO: 32834 - DNA, 20 bp, Artificial Sequence
  Description of Artificial Sequence: Synthetic oligonucleotide
  Target: FXN; (+) strand; PAM type: YTN; PAM sequence: CTA
tagacaattctattttgcag

SEQ ID NO: 32835 - DNA, 20 bp, Artificial Sequence
  Description of Artificial Sequence: Synthetic oligonucleotide
  Target: FXN; (+) strand; PAM type: YTN; PAM sequence: TTC
tattttgcagcgtagtattc

SEQ ID NO: 32836 - DNA, 20 bp, Artificial Sequence
  Description of Artificial Sequence: Synthetic oligonucleotide
  Target: FXN; (+) strand; PAM type: YTN; PAM sequence: CTA
ttttgcagcgtagtattcca

SEQ ID NO: 32837 - DNA, 20 bp, Artificial Sequence
  Description of Artificial Sequence: Synthetic oligonucleotide
  Target: FXN; (+) strand; PAM type: YTN; PAM sequence: TTT
tgcagcgtagtattccattg

SEQ ID NO: 32838 - DNA, 20 bp, Artificial Sequence
  Description of Artificial Sequence: Synthetic oligonucleotide
  Target: FXN; (+) strand; PAM type: YTN; PAM sequence: TTT
gcagcgtagtattccattgc

SEQ ID NO: 32839 - DNA, 20 bp, Artificial Sequence
  Description of Artificial Sequence: Synthetic oligonucleotide
  Target: FXN; (+) strand; PAM type: YTN; PAM sequence: TTG
cagcgtagtattccattgca

SEQ ID NO: 32840 - DNA, 20 bp, Artificial Sequence
  Description of Artificial Sequence: Synthetic oligonucleotide
  Target: FXN; (+) strand; PAM type: YTN; PAM sequence: TTC
cattgcatgactataccaca

SEQ ID NO: 32841 - DNA, 20 bp, Artificial Sequence
  Description of Artificial Sequence: Synthetic oligonucleotide
  Target: FXN; (+) strand; PAM type: YTN; PAM sequence: TTG
catgactataccacaattta

SEQ ID NO: 32842 - DNA, 20 bp, Artificial Sequence
  Description of Artificial Sequence: Synthetic oligonucleotide
  Target: FXN; (+) strand; PAM type: YTN; PAM sequence: CTA
taccacaatttatctgtgat

SEQ ID NO: 32843 - DNA, 20 bp, Artificial Sequence
  Description of Artificial Sequence: Synthetic oligonucleotide
  Target: FXN; (+) strand; PAM type: YTN; PAM sequence: TTT
atctgtgatattacaaagga

SEQ ID NO: 32844 - DNA, 20 bp, Artificial Sequence
  Description of Artificial Sequence: Synthetic oligonucleotide
  Target: FXN; (+) strand; PAM type: YTN; PAM sequence: TTA
tctgtgatattacaaaggaa

SEQ ID NO: 32845 - DNA, 20 bp, Artificial Sequence
  Description of Artificial Sequence: Synthetic oligonucleotide
  Target: FXN; (+) strand; PAM type: YTN; PAM sequence: CTG
tgatattacaaaggaatact

SEQ ID NO: 32846 - DNA, 20 bp, Artificial Sequence
  Description of Artificial Sequence: Synthetic oligonucleotide
  Target: FXN; (+) strand; PAM type: YTN; PAM sequence: TTA
caaaggaatacttgggcagt

SEQ ID NO: 32847 - DNA, 20 bp, Artificial Sequence
  Description of Artificial Sequence: Synthetic oligonucleotide
  Target: FXN; (+) strand; PAM type: YTN; PAM sequence: CTT
gggcagtttccagtttgggg

SEQ ID NO: 32848 - DNA, 20 bp, Artificial Sequence
  Description of Artificial Sequence: Synthetic oligonucleotide
  Target: FXN; (+) strand; PAM type: YTN; PAM sequence: TTG
ggcagtttccagtttggggc

SEQ ID NO: 32849 - DNA, 20 bp, Artificial Sequence
  Description of Artificial Sequence: Synthetic oligonucleotide
  Target: FXN; (+) strand; PAM type: YTN; PAM sequence: TTT
ccagtttggggctataggat

SEQ ID NO: 32850 - DNA, 20 bp, Artificial Sequence
  Description of Artificial Sequence: Synthetic oligonucleotide
  Target: FXN; (+) strand; PAM type: YTN; PAM sequence: TTC
cagtttggggctataggata

SEQ ID NO: 32851 - DNA, 20 bp, Artificial Sequence
  Description of Artificial Sequence: Synthetic oligonucleotide
  Target: FXN; (+) strand; PAM type: YTN; PAM sequence: TTT
ggggctataggatagttgtg

SEQ ID NO: 32852 - DNA, 20 bp, Artificial Sequence
  Description of Artificial Sequence: Synthetic oligonucleotide
  Target: FXN; (+) strand; PAM type: YTN; PAM sequence: TTG
gggctataggatagttgtga

SEQ ID NO: 32853 - DNA, 20 bp, Artificial Sequence
  Description of Artificial Sequence: Synthetic oligonucleotide
  Target: FXN; (+) strand; PAM type: YTN; PAM sequence: CTA
taggatagttgtgatacaaa

SEQ ID NO: 32854 - DNA, 20 bp, Artificial Sequence
  Description of Artificial Sequence: Synthetic oligonucleotide
  Target: FXN; (+) strand; PAM type: YTN; PAM sequence: TTG
tgatacaaatattttagtat

SEQ ID NO: 32855 - DNA, 20 bp, Artificial Sequence
  Description of Artificial Sequence: Synthetic oligonucleotide
  Target: FXN; (+) strand; PAM type: YTN; PAM sequence: TTT
tagtatagtacatgtctttt

SEQ ID NO: 32856 - DNA, 20 bp, Artificial Sequence
  Description of Artificial Sequence: Synthetic oligonucleotide
  Target: FXN; (+) strand; PAM type: YTN; PAM sequence: TTT
agtatagtacatgtcttttg

SEQ ID NO: 32857 - DNA, 20 bp, Artificial Sequence
  Description of Artificial Sequence: Synthetic oligonucleotide
  Target: FXN; (+) strand; PAM type: YTN; PAM sequence: TTA
gtatagtacatgtcttttgg

SEQ ID NO: 32858 - DNA, 20 bp, Artificial Sequence
  Description of Artificial Sequence: Synthetic oligonucleotide
  Target: FXN; (+) strand; PAM type: YTN; PAM sequence: CTT
ttggtgaacctgggtacaca

SEQ ID NO: 32859 - DNA, 20 bp, Artificial Sequence
  Description of Artificial Sequence: Synthetic oligonucleotide
  Target: FXN; (+) strand; PAM type: YTN; PAM sequence: TTT
tggtgaacctgggtacacat

SEQ ID NO: 32860 - DNA, 20 bp, Artificial Sequence
  Description of Artificial Sequence: Synthetic oligonucleotide
  Target: FXN; (+) strand; PAM type: YTN; PAM sequence: TTT
ggtgaacctgggtacacatt

SEQ ID NO: 32861 - DNA, 20 bp, Artificial Sequence
  Description of Artificial Sequence: Synthetic oligonucleotide
  Target: FXN; (+) strand; PAM type: YTN; PAM sequence: TTG
gtgaacctgggtacacattt

SEQ ID NO: 32862 - DNA, 20 bp, Artificial Sequence
  Description of Artificial Sequence: Synthetic oligonucleotide
  Target: FXN; (+) strand; PAM type: YTN; PAM sequence: CTG
ggtacacatttctgttgtgt

SEQ ID NO: 32863 - DNA, 20 bp, Artificial Sequence
  Description of Artificial Sequence: Synthetic oligonucleotide
  Target: FXN; (+) strand; PAM type: YTN; PAM sequence: TTT
ctgttgtgtataccccttaa

SEQ ID NO: 32864 - DNA, 20 bp, Artificial Sequence
  Description of Artificial Sequence: Synthetic oligonucleotide
  Target: FXN; (+) strand; PAM type: YTN; PAM sequence: TTC
tgttgtgtataccccttaag

SEQ ID NO: 32865 - DNA, 20 bp, Artificial Sequence
  Description of Artificial Sequence: Synthetic oligonucleotide
  Target: FXN; (+) strand; PAM type: YTN; PAM sequence: CTG
ttgtgtataccccttaagag

SEQ ID NO: 32866 - DNA, 20 bp, Artificial Sequence
  Description of Artificial Sequence: Synthetic oligonucleotide
  Target: FXN; (+) strand; PAM type: YTN; PAM sequence: TTG
tgtataccccttaagagtgg

SEQ ID NO: 32867 - DNA, 20 bp, Artificial Sequence
  Description of Artificial Sequence: Synthetic oligonucleotide
  Target: FXN; (+) strand; PAM type: YTN; PAM sequence: CTT
aagagtggagctgatgatcc

SEQ ID NO: 32868 - DNA, 20 bp, Artificial Sequence
  Description of Artificial Sequence: Synthetic oligonucleotide
  Target: FXN; (+) strand; PAM type: YTN; PAM sequence: TTA
agagtggagctgatgatcct

SEQ ID NO: 32869 - DNA, 20 bp, Artificial Sequence
  Description of Artificial Sequence: Synthetic oligonucleotide
  Target: FXN; (+) strand; PAM type: YTN; PAM sequence: CTG
atgatcctggctaacaaggt

SEQ ID NO: 32870 - DNA, 20 bp, Artificial Sequence
  Description of Artificial Sequence: Synthetic oligonucleotide
  Target: FXN; (+) strand; PAM type: YTN; PAM sequence: CTG
gctaacaaggtgaaaccccg

SEQ ID NO: 32871 - DNA, 20 bp, Artificial Sequence
  Description of Artificial Sequence: Synthetic oligonucleotide
  Target: FXN; (+) strand; PAM type: YTN; PAM sequence: CTA
acaaggtgaaaccccgtctc

SEQ ID NO: 32872 - DNA, 20 bp, Artificial Sequence
  Description of Artificial Sequence: Synthetic oligonucleotide
  Target: FXN; (+) strand; PAM type: YTN; PAM sequence: CTC
tactaaaaatacaaaaaatt

SEQ ID NO: 32873 - DNA, 20 bp, Artificial Sequence
  Description of Artificial Sequence: Synthetic oligonucleotide
  Target: FXN; (+) strand; PAM type: YTN; PAM sequence: CTA
ctaaaaatacaaaaaattag

SEQ ID NO: 32874 - DNA, 20 bp, Artificial Sequence
  Description of Artificial Sequence: Synthetic oligonucleotide
  Target: FXN; (+) strand; PAM type: YTN; PAM sequence: CTA
aaaatacaaaaaattagccg

SEQ ID NO: 32875 - DNA, 20 bp, Artificial Sequence
  Description of Artificial Sequence: Synthetic oligonucleotide
  Target: FXN; (+) strand; PAM type: YTN; PAM sequence: TTA
gccgggcgtggtagcgggcg

SEQ ID NO: 32876 - DNA, 20 bp, Artificial Sequence
  Description of Artificial Sequence: Synthetic oligonucleotide
  Target: FXN; (+) strand; PAM type: YTN; PAM sequence: CTG
tagtcccagctactcgggag

SEQ ID NO: 32877 - DNA, 20 bp, Artificial Sequence
  Description of Artificial Sequence: Synthetic oligonucleotide
  Target: FXN; (+) strand; PAM type: YTN; PAM sequence: CTA
ctcgggaggctgaggcagga

SEQ ID NO: 32878 - DNA, 20 bp, Artificial Sequence
  Description of Artificial Sequence: Synthetic oligonucleotide
  Target: FXN; (+) strand; PAM type: YTN; PAM sequence: CTC
gggaggctgaggcaggagaa

SEQ ID NO: 32879 - DNA, 20 bp, Artificial Sequence
  Description of Artificial Sequence: Synthetic oligonucleotide
  Target: FXN; (+) strand; PAM type: YTN; PAM sequence: CTG
aggcaggagaatggcgtgaa

SEQ ID NO: 32880 - DNA, 20 bp, Artificial Sequence
  Description of Artificial Sequence: Synthetic oligonucleotide
  Target: FXN; (+) strand; PAM type: YTN; PAM sequence: CTT
gcttgcagtgagccgagatc

SEQ ID NO: 32881 - DNA, 20 bp, Artificial Sequence
  Description of Artificial Sequence: Synthetic oligonucleotide
  Target: FXN; (+) strand; PAM type: YTN; PAM sequence: TTG
cttgcagtgagccgagatcg

SEQ ID NO: 32882 - DNA, 20 bp, Artificial Sequence
  Description of Artificial Sequence: Synthetic oligonucleotide
  Target: FXN; (+) strand; PAM type: YTN; PAM sequence: CTT
gcagtgagccgagatcgcgc

SEQ ID NO: 32883 - DNA, 20 bp, Artificial Sequence
  Description of Artificial Sequence: Synthetic oligonucleotide
  Target: FXN; (+) strand; PAM type: YTN; PAM sequence: TTG
cagtgagccgagatcgcgcc

SEQ ID NO: 32884 - DNA, 20 bp, Artificial Sequence
  Description of Artificial Sequence: Synthetic oligonucleotide
  Target: FXN; (+) strand; PAM type: YTN; PAM sequence: CTG
cactccagcctgggcgacag

SEQ ID NO: 32885 - DNA, 20 bp, Artificial Sequence
  Description of Artificial Sequence: Synthetic oligonucleotide
  Target: FXN; (+) strand; PAM type: YTN; PAM sequence: CTC
cagcctgggcgacagagcga

SEQ ID NO: 32886 - DNA, 20 bp, Artificial Sequence
  Description of Artificial Sequence: Synthetic oligonucleotide
  Target: FXN; (+) strand; PAM type: YTN; PAM sequence: CTG
ggcgacagagcgagactccg

SEQ ID NO: 32887 - DNA, 20 bp, Artificial Sequence
  Description of Artificial Sequence: Synthetic oligonucleotide
  Target: FXN; (+) strand; PAM type: YTN; PAM sequence: CTC
cgtctcaaaaaaaaaaaaaa

SEQ ID NO: 32888 - DNA, 20 bp, Artificial Sequence
  Description of Artificial Sequence: Synthetic oligonucleotide
  Target: FXN; (+) strand; PAM type: YTN; PAM sequence: CTC
aaaaaaaaaaaaaaaaaaag

SEQ ID NO: 32889 - DNA, 20 bp, Artificial Sequence
  Description of Artificial Sequence: Synthetic oligonucleotide
  Target: FXN; (+) strand; PAM type: YTN; PAM sequence: CTG
atgggtcatagcatgtaaat

SEQ ID NO: 32890 - DNA, 20 bp, Artificial Sequence
  Description of Artificial Sequence: Synthetic oligonucleotide
  Target: FXN; (+) strand; PAM type: YTN; PAM sequence: TTC
aactttagtagatactgtcc

SEQ ID NO: 32891 - DNA, 20 bp, Artificial Sequence
  Description of Artificial Sequence: Synthetic oligonucleotide
  Target: FXN; (+) strand; PAM type: YTN; PAM sequence: CTT
tagtagatactgtccaacag

SEQ ID NO: 32892 - DNA, 20 bp, Artificial Sequence
  Description of Artificial Sequence: Synthetic oligonucleotide
  Target: FXN; (+) strand; PAM type: YTN; PAM sequence: TTT
agtagatactgtccaacagt

SEQ ID NO: 32893 - DNA, 20 bp, Artificial Sequence
  Description of Artificial Sequence: Synthetic oligonucleotide
  Target: FXN; (+) strand; PAM type: YTN; PAM sequence: TTA
gtagatactgtccaacagtt

SEQ ID NO: 32894 - DNA, 20 bp, Artificial Sequence
  Description of Artificial Sequence: Synthetic oligonucleotide
  Target: FXN; (+) strand; PAM type: YTN; PAM sequence: CTG
tccaacagttttccaaagtg

SEQ ID NO: 32895 - DNA, 20 bp, Artificial Sequence
  Description of Artificial Sequence: Synthetic oligonucleotide
  Target: FXN; (+) strand; PAM type: YTN; PAM sequence: TTT
tccaaagtgattgtccaact

SEQ ID NO: 32896 - DNA, 20 bp, Artificial Sequence
  Description of Artificial Sequence: Synthetic oligonucleotide
  Target: FXN; (+) strand; PAM type: YTN; PAM sequence: TTT
ccaaagtgattgtccaactt

SEQ ID NO: 32897 - DNA, 20 bp, Artificial Sequence
  Description of Artificial Sequence: Synthetic oligonucleotide
  Target: FXN; (+) strand; PAM type: YTN; PAM sequence: TTC
caaagtgattgtccaactta

SEQ ID NO: 32898 - DNA, 20 bp, Artificial Sequence
  Description of Artificial Sequence: Synthetic oligonucleotide
  Target: FXN; (+) strand; PAM type: YTN; PAM sequence: TTG
tccaacttacttgcctatca

SEQ ID NO: 32899 - DNA, 20 bp, Artificial Sequence
  Description of Artificial Sequence: Synthetic oligonucleotide
  Target: FXN; (+) strand; PAM type: YTN; PAM sequence: CTT
acttgcctatcagcagtatc

SEQ ID NO: 32900 - DNA, 20 bp, Artificial Sequence
  Description of Artificial Sequence: Synthetic oligonucleotide
  Target: FXN; (+) strand; PAM type: YTN; PAM sequence: TTA
cttgcctatcagcagtatct

SEQ ID NO: 32901 - DNA, 20 bp, Artificial Sequence
  Description of Artificial Sequence: Synthetic oligonucleotide
  Target: FXN; (+) strand; PAM type: YTN; PAM sequence: CTT
gcctatcagcagtatctgaa

SEQ ID NO: 32902 - DNA, 20 bp, Artificial Sequence
  Description of Artificial Sequence: Synthetic oligonucleotide
  Target: FXN; (+) strand; PAM type: YTN; PAM sequence: TTG
cctatcagcagtatctgaaa

SEQ ID NO: 32903 - DNA, 20 bp, Artificial Sequence
  Description of Artificial Sequence: Synthetic oligonucleotide
  Target: FXN; (+) strand; PAM type: YTN; PAM sequence: CTA
tcagcagtatctgaaaagtc

SEQ ID NO: 32904 - DNA, 20 bp, Artificial Sequence
  Description of Artificial Sequence: Synthetic oligonucleotide
  Target: FXN; (+) strand; PAM type: YTN; PAM sequence: CTG
aaaagtctagttgcttcttt

SEQ ID NO: 32905 - DNA, 20 bp, Artificial Sequence
  Description of Artificial Sequence: Synthetic oligonucleotide
  Target: FXN; (+) strand; PAM type: YTN; PAM sequence: CTA
gttgcttcttttcttggcca

SEQ ID NO: 32906 - DNA, 20 bp, Artificial Sequence
  Description of Artificial Sequence: Synthetic oligonucleotide
  Target: FXN; (+) strand; PAM type: YTN; PAM sequence: TTG
cttcttttcttggccaactc

SEQ ID NO: 32907 - DNA, 20 bp, Artificial Sequence
  Description of Artificial Sequence: Synthetic oligonucleotide
  Target: FXN; (+) strand; PAM type: YTN; PAM sequence: CTT
cttttcttggccaactcttt

SEQ ID NO: 32908 - DNA, 20 bp, Artificial Sequence
  Description of Artificial Sequence: Synthetic oligonucleotide
  Target: FXN; (+) strand; PAM type: YTN; PAM sequence: TTC
ttttcttggccaactctttt

SEQ ID NO: 32909 - DNA, 20 bp, Artificial Sequence
  Description of Artificial Sequence: Synthetic oligonucleotide
  Target: FXN; (+) strand; PAM type: YTN; PAM sequence: CTT
ttcttggccaactctttttt

SEQ ID NO: 32910 - DNA, 20 bp, Artificial Sequence
  Description of Artificial Sequence: Synthetic oligonucleotide
  Target: FXN; (+) strand; PAM type: YTN; PAM sequence: TTT
tcttggccaactcttttttt

SEQ ID NO: 32911 - DNA, 20 bp, Artificial Sequence
  Description of Artificial Sequence: Synthetic oligonucleotide
  Target: FXN; (+) strand; PAM type: YTN; PAM sequence: TTT
cttggccaactctttttttt

SEQ ID NO: 32912 - DNA, 20 bp, Artificial Sequence
  Description of Artificial Sequence: Synthetic oligonucleotide
  Target: FXN; (+) strand; PAM type: YTN; PAM sequence: TTC
ttggccaactcttttttttt

SEQ ID NO: 32913 - DNA, 20 bp, Artificial Sequence
  Description of Artificial Sequence: Synthetic oligonucleotide
  Target: FXN; (+) strand; PAM type: YTN; PAM sequence: CTT
ggccaactcttttttttttt

SEQ ID NO: 32914 - DNA, 20 bp, Artificial Sequence
  Description of Artificial Sequence: Synthetic oligonucleotide
  Target: FXN; (+) strand; PAM type: YTN; PAM sequence: TTG
gccaactctttttttttttt

SEQ ID NO: 32915 - DNA, 20 bp, Artificial Sequence
  Description of Artificial Sequence: Synthetic oligonucleotide
  Target: FXN; (+) strand; PAM type: YTN; PAM sequence: CTC
tttttttttttttgagatgg

SEQ ID NO: 32916 - DNA, 20 bp, Artificial Sequence
  Description of Artificial Sequence: Synthetic oligonucleotide
  Target: FXN; (+) strand; PAM type: YTN; PAM sequence: CTT
tttttttttttgagatggag

SEQ ID NO: 32917 - DNA, 20 bp, Artificial Sequence
  Description of Artificial Sequence: Synthetic oligonucleotide
  Target: FXN; (+) strand; PAM type: YTN; PAM sequence: TTT
ttttttttttgagatggagt

SEQ ID NO: 32918 - DNA, 20 bp, Artificial Sequence
  Description of Artificial Sequence: Synthetic oligonucleotide
  Target: FXN; (+) strand; PAM type: YTN; PAM sequence: TTT
tttttttttgagatggagtt

SEQ ID NO: 32919 - DNA, 20 bp, Artificial Sequence
  Description of Artificial Sequence: Synthetic oligonucleotide
  Target: FXN; (+) strand; PAM type: YTN; PAM sequence: TTT
ttttttttgagatggagttt

SEQ ID NO: 32920 - DNA, 20 bp, Artificial Sequence
  Description of Artificial Sequence: Synthetic oligonucleotide
  Target: FXN; (+) strand; PAM type: YTN; PAM sequence: TTT
tttttttgagatggagtttt

SEQ ID NO: 32921 - DNA, 20 bp, Artificial Sequence
  Description of Artificial Sequence: Synthetic oligonucleotide
  Target: FXN; (+) strand; PAM type: YTN; PAM sequence: TTT
ttttttgagatggagttttg

SEQ ID NO: 32922 - DNA, 20 bp, Artificial Sequence
  Description of Artificial Sequence: Synthetic oligonucleotide
  Target: FXN; (+) strand; PAM type: YTN; PAM sequence: TTT
tttttgagatggagttttgc

SEQ ID NO: 32923 - DNA, 20 bp, Artificial Sequence
  Description of Artificial Sequence: Synthetic oligonucleotide
  Target: FXN; (+) strand; PAM type: YTN; PAM sequence: TTT
ttttgagatggagttttgct

SEQ ID NO: 32924 - DNA, 20 bp, Artificial Sequence
  Description of Artificial Sequence: Synthetic oligonucleotide
  Target: FXN; (+) strand; PAM type: YTN; PAM sequence: TTT
tttgagatggagttttgctc

SEQ ID NO: 32925 - DNA, 20 bp, Artificial Sequence
  Description of Artificial Sequence: Synthetic oligonucleotide
  Target: FXN; (+) strand; PAM type: YTN; PAM sequence: TTT
ttgagatggagttttgctct

SEQ ID NO: 32926 - DNA, 20 bp, Artificial Sequence
  Description of Artificial Sequence: Synthetic oligonucleotide
  Target: FXN; (+) strand; PAM type: YTN; PAM sequence: TTT
tgagatggagttttgctctt

SEQ ID NO: 32927 - DNA, 20 bp, Artificial Sequence
  Description of Artificial Sequence: Synthetic oligonucleotide
  Target: FXN; (+) strand; PAM type: YTN; PAM sequence: TTT
gagatggagttttgctcttg

SEQ ID NO: 32928 - DNA, 20 bp, Artificial Sequence
  Description of Artificial Sequence: Synthetic oligonucleotide
  Target: FXN; (+) strand; PAM type: YTN; PAM sequence: TTG
agatggagttttgctcttgt

SEQ ID NO: 32929 - DNA, 20 bp, Artificial Sequence
  Description of Artificial Sequence: Synthetic oligonucleotide
  Target: FXN; (+) strand; PAM type: YTN; PAM sequence: TTT
tgctcttgttgcccaggctg

SEQ ID NO: 32930 - DNA, 20 bp, Artificial Sequence
  Description of Artificial Sequence: Synthetic oligonucleotide
  Target: FXN; (+) strand; PAM type: YTN; PAM sequence: TTT
gctcttgttgcccaggctgg

SEQ ID NO: 32931 - DNA, 20 bp, Artificial Sequence
  Description of Artificial Sequence: Synthetic oligonucleotide
  Target: FXN; (+) strand; PAM type: YTN; PAM sequence: TTG
ctcttgttgcccaggctgga

SEQ ID NO: 32932 - DNA, 20 bp, Artificial Sequence
  Description of Artificial Sequence: Synthetic oligonucleotide
  Target: FXN; (+) strand; PAM type: YTN; PAM sequence: CTC
ttgttgcccaggctggagcg

SEQ ID NO: 32933 - DNA, 20 bp, Artificial Sequence
  Description of Artificial Sequence: Synthetic oligonucleotide
  Target: FXN; (+) strand; PAM type: YTN; PAM sequence: CTT
gttgcccaggctggagcgca

SEQ ID NO: 32934 - DNA, 20 bp, Artificial Sequence
  Description of Artificial Sequence: Synthetic oligonucleotide
  Target: FXN; (+) strand; PAM type: YTN; PAM sequence: TTG
ttgcccaggctggagcgcaa

SEQ ID NO: 32935 - DNA, 20 bp, Artificial Sequence
  Description of Artificial Sequence: Synthetic oligonucleotide
  Target: FXN; (+) strand; PAM type: YTN; PAM sequence: TTG
cccaggctggagcgcaatgg

SEQ ID NO: 32936 - DNA, 20 bp, Artificial Sequence
  Description of Artificial Sequence: Synthetic oligonucleotide
  Target: FXN; (+) strand; PAM type: YTN; PAM sequence: CTG
gagcgcaatggcacgtcctc

SEQ ID NO: 32937 - DNA, 20 bp, Artificial Sequence
  Description of Artificial Sequence: Synthetic oligonucleotide
  Target: FXN; (+) strand; PAM type: YTN; PAM sequence: CTC
tgctcactgcaacctccgcc

SEQ ID NO: 32938 - DNA, 20 bp, Artificial Sequence
  Description of Artificial Sequence: Synthetic oligonucleotide
  Target: FXN; (+) strand; PAM type: YTN; PAM sequence: CTG
ctcactgcaacctccgcctc

SEQ ID NO: 32939 - DNA, 20 bp, Artificial Sequence
  Description of Artificial Sequence: Synthetic oligonucleotide
  Target: FXN; (+) strand; PAM type: YTN; PAM sequence: CTC
actgcaacctccgcctcctg

SEQ ID NO: 32940 - DNA, 20 bp, Artificial Sequence
  Description of Artificial Sequence: Synthetic oligonucleotide
  Target: FXN; (+) strand; PAM type: YTN; PAM sequence: CTG
caacctccgcctcctgggtt

SEQ ID NO: 32941 - DNA, 20 bp, Artificial Sequence
  Description of Artificial Sequence: Synthetic oligonucleotide
  Target: FXN; (+) strand; PAM type: YTN; PAM sequence: CTC
cgcctcctgggttcaagcaa

SEQ ID NO: 32942 - DNA, 20 bp, Artificial Sequence
  Description of Artificial Sequence: Synthetic oligonucleotide
  Target: FXN; (+) strand; PAM type: YTN; PAM sequence: CTC
ctgggttcaagcaattctcc

SEQ ID NO: 32943 - DNA, 20 bp, Artificial Sequence
  Description of Artificial Sequence: Synthetic oligonucleotide
  Target: FXN; (+) strand; PAM type: YTN; PAM sequence: CTG
ggttcaagcaattctcctgc

SEQ ID NO: 32944 - DNA, 20 bp, Artificial Sequence
  Description of Artificial Sequence: Synthetic oligonucleotide
  Target: FXN; (+) strand; PAM type: YTN; PAM sequence: TTC
aagcaattctcctgcctcag

SEQ ID NO: 32945 - DNA, 20 bp, Artificial Sequence
  Description of Artificial Sequence: Synthetic oligonucleotide
  Target: FXN; (+) strand; PAM type: YTN; PAM sequence: TTC
tcctgcctcagcctcccgag

SEQ ID NO: 32946 - DNA, 20 bp, Artificial Sequence
  Description of Artificial Sequence: Synthetic oligonucleotide
  Target: FXN; (+) strand; PAM type: YTN; PAM sequence: CTC
ctgcctcagcctcccgagta

SEQ ID NO: 32947 - DNA, 20 bp, Artificial Sequence
  Description of Artificial Sequence: Synthetic oligonucleotide
  Target: FXN; (+) strand; PAM type: YTN; PAM sequence: CTG
cctcagcctcccgagtagct

SEQ ID NO: 32948 - DNA, 20 bp, Artificial Sequence
  Description of Artificial Sequence: Synthetic oligonucleotide
  Target: FXN; (+) strand; PAM type: YTN; PAM sequence: CTC
agcctcccgagtagctggga

SEQ ID NO: 32949 - DNA, 20 bp, Artificial Sequence
  Description of Artificial Sequence: Synthetic oligonucleotide
  Target: FXN; (+) strand; PAM type: YTN; PAM sequence: CTC
ccgagtagctgggattacag

SEQ ID NO: 32950 - DNA, 20 bp, Artificial Sequence
  Description of Artificial Sequence: Synthetic oligonucleotide
  Target: FXN; (+) strand; PAM type: YTN; PAM sequence: CTG
ggattacaggcatgcgccac

SEQ ID NO: 32951 - DNA, 20 bp, Artificial Sequence
  Description of Artificial Sequence: Synthetic oligonucleotide
  Target: FXN; (+) strand; PAM type: YTN; PAM sequence: TTA
caggcatgcgccactatgcc

SEQ ID NO: 32952 - DNA, 20 bp, Artificial Sequence
  Description of Artificial Sequence: Synthetic oligonucleotide
  Target: FXN; (+) strand; PAM type: YTN; PAM sequence: CTA
tgcccggctaattttgtatt

SEQ ID NO: 32953 - DNA, 20 bp, Artificial Sequence
  Description of Artificial Sequence: Synthetic oligonucleotide
  Target: FXN; (+) strand; PAM type: YTN; PAM sequence: CTA
attttgtatttttagtagag

SEQ ID NO: 32954 - DNA, 20 bp, Artificial Sequence
  Description of Artificial Sequence: Synthetic oligonucleotide
  Target: FXN; (+) strand; PAM type: YTN; PAM sequence: TTT
tgtatttttagtagagacag

SEQ ID NO: 32955 - DNA, 20 bp, Artificial Sequence
  Description of Artificial Sequence: Synthetic oligonucleotide
  Target: FXN; (+) strand; PAM type: YTN; PAM sequence: TTT
gtatttttagtagagacagg

SEQ ID NO: 32956 - DNA, 20 bp, Artificial Sequence
  Description of Artificial Sequence: Synthetic oligonucleotide
  Target: FXN; (+) strand; PAM type: YTN; PAM sequence: TTG
tatttttagtagagacaggg

SEQ ID NO: 32957 - DNA, 20 bp, Artificial Sequence
  Description of Artificial Sequence: Synthetic oligonucleotide
  Target: FXN; (+) strand; PAM type: YTN; PAM sequence: TTT
ttagtagagacagggtttct

SEQ ID NO: 32958 - DNA, 20 bp, Artificial Sequence
  Description of Artificial Sequence: Synthetic oligonucleotide
  Target: FXN; (+) strand; PAM type: YTN; PAM sequence: TTT
tagtagagacagggtttctc

SEQ ID NO: 32959 - DNA, 20 bp, Artificial Sequence
  Description of Artificial Sequence: Synthetic oligonucleotide
  Target: FXN; (+) strand; PAM type: YTN; PAM sequence: TTT
agtagagacagggtttctcc

SEQ ID NO: 32960 - DNA, 20 bp, Artificial Sequence
  Description of Artificial Sequence: Synthetic oligonucleotide
  Target: FXN; (+) strand; PAM type: YTN; PAM sequence: TTA
gtagagacagggtttctcca

SEQ ID NO: 32961 - DNA, 20 bp, Artificial Sequence
  Description of Artificial Sequence: Synthetic oligonucleotide
  Target: FXN; (+) strand; PAM type: YTN; PAM sequence: TTT
ctccatgttggtcaagctgg

SEQ ID NO: 32962 - DNA, 20 bp, Artificial Sequence
  Description of Artificial Sequence: Synthetic oligonucleotide
  Target: FXN; (+) strand; PAM type: YTN; PAM sequence: TTC
tccatgttggtcaagctggt

SEQ ID NO: 32963 - DNA, 20 bp, Artificial Sequence
  Description of Artificial Sequence: Synthetic oligonucleotide
  Target: FXN; (+) strand; PAM type: YTN; PAM sequence: CTC
catgttggtcaagctggtct

SEQ ID NO: 32964 - DNA, 20 bp, Artificial Sequence
  Description of Artificial Sequence: Synthetic oligonucleotide
  Target: FXN; (+) strand; PAM type: YTN; PAM sequence: TTG
gtcaagctggtctcgaactc

SEQ ID NO: 32965 - DNA, 20 bp, Artificial Sequence
  Description of Artificial Sequence: Synthetic oligonucleotide
  Target: FXN; (+) strand; PAM type: YTN; PAM sequence: CTG
gtctcgaactcctaacctca

SEQ ID NO: 32966 - DNA, 20 bp, Artificial Sequence
  Description of Artificial Sequence: Synthetic oligonucleotide
  Target: FXN; (+) strand; PAM type: YTN; PAM sequence: CTC
gaactcctaacctcaggtga

SEQ ID NO: 32967 - DNA, 20 bp, Artificial Sequence
  Description of Artificial Sequence: Synthetic oligonucleotide
  Target: FXN; (+) strand; PAM type: YTN; PAM sequence: CTC
ctaacctcaggtgatccgcc

SEQ ID NO: 32968 - DNA, 20 bp, Artificial Sequence
  Description of Artificial Sequence: Synthetic oligonucleotide
  Target: FXN; (+) strand; PAM type: YTN; PAM sequence: CTA
acctcaggtgatccgcccgc

SEQ ID NO: 32969 - DNA, 20 bp, Artificial Sequence
  Description of Artificial Sequence: Synthetic oligonucleotide
  Target: FXN; (+) strand; PAM type: YTN; PAM sequence: CTC
aggtgatccgcccgcctcgg

SEQ ID NO: 32970 - DNA, 20 bp, Artificial Sequence
  Description of Artificial Sequence: Synthetic oligonucleotide
  Target: FXN; (+) strand; PAM type: YTN; PAM sequence: CTC
ggcctcccgaagtgctggga

SEQ ID NO: 32971 - DNA, 20 bp, Artificial Sequence
  Description of Artificial Sequence: Synthetic oligonucleotide
  Target: FXN; (+) strand; PAM type: YTN; PAM sequence: CTC
ccgaagtgctgggattacag

SEQ ID NO: 32972 - DNA, 20 bp, Artificial Sequence
  Description of Artificial Sequence: Synthetic oligonucleotide
  Target: FXN; (+) strand; PAM type: YTN; PAM sequence: CTG
ggattacaggcatgagccac

SEQ ID NO: 32973 - DNA, 20 bp, Artificial Sequence
  Description of Artificial Sequence: Synthetic oligonucleotide
  Target: FXN; (+) strand; PAM type: YTN; PAM sequence: TTA
caggcatgagccaccgcgcc

SEQ ID NO: 32974 - DNA, 20 bp, Artificial Sequence
  Description of Artificial Sequence: Synthetic oligonucleotide
  Target: FXN; (+) strand; PAM type: YTN; PAM sequence: CTC
ttttttattttattttattt

SEQ ID NO: 32975 - DNA, 20 bp, Artificial Sequence
  Description of Artificial Sequence: Synthetic oligonucleotide
  Target: FXN; (+) strand; PAM type: YTN; PAM sequence: CTT
ttttattttattttatttta

SEQ ID NO: 32976 - DNA, 20 bp, Artificial Sequence
  Description of Artificial Sequence: Synthetic oligonucleotide
  Target: FXN; (+) strand; PAM type: YTN; PAM sequence: TTT
tttattttattttattttac

SEQ ID NO: 32977 - DNA, 20 bp, Artificial Sequence
  Description of Artificial Sequence: Synthetic oligonucleotide
  Target: FXN; (+) strand; PAM type: YTN; PAM sequence: TTT
ttattttattttattttact

SEQ ID NO: 32978 - DNA, 20 bp, Artificial Sequence
  Description of Artificial Sequence: Synthetic oligonucleotide
  Target: FXN; (+) strand; PAM type: YTN; PAM sequence: TTT
tattttattttattttactt

SEQ ID NO: 32979 - DNA, 20 bp, Artificial Sequence
  Description of Artificial Sequence: Synthetic oligonucleotide
  Target: FXN; (+) strand; PAM type: YTN; PAM sequence: TTT
attttattttattttacttt

SEQ ID NO: 32980 - DNA, 20 bp, Artificial Sequence
  Description of Artificial Sequence: Synthetic oligonucleotide
  Target: FXN; (+) strand; PAM type: YTN; PAM sequence: TTA
ttttattttattttacttta

SEQ ID NO: 32981 - DNA, 20 bp, Artificial Sequence
  Description of Artificial Sequence: Synthetic oligonucleotide
  Target: FXN; (+) strand; PAM type: YTN; PAM sequence: TTT
tattttattttactttaaag

SEQ ID NO: 32982 - DNA, 20 bp, Artificial Sequence
  Description of Artificial Sequence: Synthetic oligonucleotide
  Target: FXN; (+) strand; PAM type: YTN; PAM sequence: TTT
attttattttactttaaaga

SEQ ID NO: 32983 - DNA, 20 bp, Artificial Sequence
  Description of Artificial Sequence: Synthetic oligonucleotide
  Target: FXN; (+) strand; PAM type: YTN; PAM sequence: TTA
ttttattttactttaaagac

SEQ ID NO: 32984 - DNA, 20 bp, Artificial Sequence
  Description of Artificial Sequence: Synthetic oligonucleotide
  Target: FXN; (+) strand; PAM type: YTN; PAM sequence: TTT
tattttactttaaagacagg

SEQ ID NO: 32985 - DNA, 20 bp, Artificial Sequence
  Description of Artificial Sequence: Synthetic oligonucleotide
  Target: FXN; (+) strand; PAM type: YTN; PAM sequence: TTT
attttactttaaagacaggg

SEQ ID NO: 32986 - DNA, 20 bp, Artificial Sequence
  Description of Artificial Sequence: Synthetic oligonucleotide
  Target: FXN; (+) strand; PAM type: YTN; PAM sequence: TTA
ttttactttaaagacagggt

SEQ ID NO: 32987 - DNA, 20 bp, Artificial Sequence
  Description of Artificial Sequence: Synthetic oligonucleotide
  Target: FXN; (+) strand; PAM type: YTN; PAM sequence: TTT
tactttaaagacagggtttc

SEQ ID NO: 32988 - DNA, 20 bp, Artificial Sequence
  Description of Artificial Sequence: Synthetic oligonucleotide
  Target: FXN; (+) strand; PAM type: YTN; PAM sequence: TTT
actttaaagacagggtttca

SEQ ID NO: 32989 - DNA, 20 bp, Artificial Sequence
  Description of Artificial Sequence: Synthetic oligonucleotide
  Target: FXN; (+) strand; PAM type: YTN; PAM sequence: TTA
ctttaaagacagggtttcac

SEQ ID NO: 32990 - DNA, 20 bp, Artificial Sequence
  Description of Artificial Sequence: Synthetic oligonucleotide
  Target: FXN; (+) strand; PAM type: YTN; PAM sequence: CTT
taaagacagggtttcacttt

SEQ ID NO: 32991 - DNA, 20 bp, Artificial Sequence
  Description of Artificial Sequence: Synthetic oligonucleotide
  Target: FXN; (+) strand; PAM type: YTN; PAM sequence: TTT
aaagacagggtttcactttg

SEQ ID NO: 32992 - DNA, 20 bp, Artificial Sequence
  Description of Artificial Sequence: Synthetic oligonucleotide
  Target: FXN; (+) strand; PAM type: YTN; PAM sequence: TTA
aagacagggtttcactttgt

SEQ ID NO: 32993 - DNA, 20 bp, Artificial Sequence
  Description of Artificial Sequence: Synthetic oligonucleotide
  Target: FXN; (+) strand; PAM type: YTN; PAM sequence: TTT
cactttgtcacccaggatgg

SEQ ID NO: 32994 - DNA, 20 bp, Artificial Sequence
  Description of Artificial Sequence: Synthetic oligonucleotide
  Target: FXN; (+) strand; PAM type: YTN; PAM sequence: TTC
actttgtcacccaggatgga

SEQ ID NO: 32995 - DNA, 20 bp, Artificial Sequence
  Description of Artificial Sequence: Synthetic oligonucleotide
  Target: FXN; (+) strand; PAM type: YTN; PAM sequence: CTT
tgtcacccaggatggaatgc

SEQ ID NO: 32996 - DNA, 20 bp, Artificial Sequence
  Description of Artificial Sequence: Synthetic oligonucleotide
  Target: FXN; (+) strand; PAM type: YTN; PAM sequence: TTT
gtcacccaggatggaatgca

SEQ ID NO: 32997 - DNA, 20 bp, Artificial Sequence
  Description of Artificial Sequence: Synthetic oligonucleotide
  Target: FXN; (+) strand; PAM type: YTN; PAM sequence: TTG
tcacccaggatggaatgcaa

SEQ ID NO: 32998 - DNA, 20 bp, Artificial Sequence
  Description of Artificial Sequence: Synthetic oligonucleotide
  Target: FXN; (+) strand; PAM type: YTN; PAM sequence: CTC
actgcagccttgacctccct

SEQ ID NO: 32999 - DNA, 20 bp, Artificial Sequence
  Description of Artificial Sequence: Synthetic oligonucleotide
  Target: FXN; (+) strand; PAM type: YTN; PAM sequence: CTG
cagccttgacctccctggct

SEQ ID NO: 33000 - DNA, 20 bp, Artificial Sequence
  Description of Artificial Sequence: Synthetic oligonucleotide
  Target: FXN; (+) strand; PAM type: YTN; PAM sequence: CTT
gacctccctggctcgggtga

SEQ ID NO: 33001 - DNA, 20 bp, Artificial Sequence
  Description of Artificial Sequence: Synthetic oligonucleotide
  Target: FXN; (+) strand; PAM type: YTN; PAM sequence: TTG
acctccctggctcgggtgat

SEQ ID NO: 33002 - DNA, 20 bp, Artificial Sequence
  Description of Artificial Sequence: Synthetic oligonucleotide
  Target: FXN; (+) strand; PAM type: YTN; PAM sequence: CTC
cctggctcgggtgatccctc

SEQ ID NO: 33003 - DNA, 20 bp, Artificial Sequence
  Description of Artificial Sequence: Synthetic oligonucleotide
  Target: FXN; (+) strand; PAM type: YTN; PAM sequence: CTG
gctcgggtgatccctcccac

SEQ ID NO: 33004 - DNA, 20 bp, Artificial Sequence
  Description of Artificial Sequence: Synthetic oligonucleotide
  Target: FXN; (+) strand; PAM type: YTN; PAM sequence: CTC
gggtgatccctcccacctca

SEQ ID NO: 33005 - DNA, 20 bp, Artificial Sequence
  Description of Artificial Sequence: Synthetic oligonucleotide
  Target: FXN; (+) strand; PAM type: YTN; PAM sequence: CTC
ccacctcaggctcctgagga

SEQ ID NO: 33006 - DNA, 20 bp, Artificial Sequence
  Description of Artificial Sequence: Synthetic oligonucleotide
  Target: FXN; (+) strand; PAM type: YTN; PAM sequence: CTC
aggctcctgaggagctagaa

SEQ ID NO: 33007 - DNA, 20 bp, Artificial Sequence
  Description of Artificial Sequence: Synthetic oligonucleotide
  Target: FXN; (+) strand; PAM type: YTN; PAM sequence: CTC
ctgaggagctagaactacag

SEQ ID NO: 33008 - DNA, 20 bp, Artificial Sequence
  Description of Artificial Sequence: Synthetic oligonucleotide
  Target: FXN; (+) strand; PAM type: YTN; PAM sequence: CTG
aggagctagaactacaggca

SEQ ID NO: 33009 - DNA, 20 bp, Artificial Sequence
  Description of Artificial Sequence: Synthetic oligonucleotide
  Target: FXN; (+) strand; PAM type: YTN; PAM sequence: CTA
gaactacaggcatgggccat

SEQ ID NO: 33010 - DNA, 20 bp, Artificial Sequence
  Description of Artificial Sequence: Synthetic oligonucleotide
  Target: FXN; (+) strand; PAM type: YTN; PAM sequence: CTA
caggcatgggccatgcccag

SEQ ID NO: 33011 - DNA, 20 bp, Artificial Sequence
  Description of Artificial Sequence: Synthetic oligonucleotide
  Target: FXN; (+) strand; PAM type: YTN; PAM sequence: CTA
attttttaatttttggtaga

SEQ ID NO: 33012 - DNA, 20 bp, Artificial Sequence
  Description of Artificial Sequence: Synthetic oligonucleotide
  Target: FXN; (+) strand; PAM type: YTN; PAM sequence: TTT
tttaatttttggtagagacg

SEQ ID NO: 33013 - DNA, 20 bp, Artificial Sequence
  Description of Artificial Sequence: Synthetic oligonucleotide
  Target: FXN; (+) strand; PAM type: YTN; PAM sequence: TTT
ttaatttttggtagagacgg

SEQ ID NO: 33014 - DNA, 20 bp, Artificial Sequence
  Description of Artificial Sequence: Synthetic oligonucleotide
  Target: FXN; (+) strand; PAM type: YTN; PAM sequence: TTT
taatttttggtagagacggg

SEQ ID NO: 33015 - DNA, 20 bp, Artificial Sequence
  Description of Artificial Sequence: Synthetic oligonucleotide
  Target: FXN; (+) strand; PAM type: YTN; PAM sequence: TTT
aatttttggtagagacgggg

SEQ ID NO: 33016 - DNA, 20 bp, Artificial Sequence
  Description of Artificial Sequence: Synthetic oligonucleotide
  Target: FXN; (+) strand; PAM type: YTN; PAM sequence: TTA
atttttggtagagacggggt

SEQ ID NO: 33017 - DNA, 20 bp, Artificial Sequence
  Description of Artificial Sequence: Synthetic oligonucleotide
  Target: FXN; (+) strand; PAM type: YTN; PAM sequence: TTT
ttggtagagacggggtctct

SEQ ID NO: 33018 - DNA, 20 bp, Artificial Sequence
  Description of Artificial Sequence: Synthetic oligonucleotide
  Target: FXN; (+) strand; PAM type: YTN; PAM sequence: TTT
tggtagagacggggtctctg

SEQ ID NO: 33019 - DNA, 20 bp, Artificial Sequence
  Description of Artificial Sequence: Synthetic oligonucleotide
  Target: FXN; (+) strand; PAM type: YTN; PAM sequence: TTT
ggtagagacggggtctctgt

SEQ ID NO: 33020 - DNA, 20 bp, Artificial Sequence
  Description of Artificial Sequence: Synthetic oligonucleotide
  Target: FXN; (+) strand; PAM type: YTN; PAM sequence: TTG
gtagagacggggtctctgtt

SEQ ID NO: 33021 - DNA, 20 bp, Artificial Sequence
  Description of Artificial Sequence: Synthetic oligonucleotide
  Target: FXN; (+) strand; PAM type: YTN; PAM sequence: CTC
tgttgtctcagattcctggg

SEQ ID NO: 33022 - DNA, 20 bp, Artificial Sequence
  Description of Artificial Sequence: Synthetic oligonucleotide
  Target: FXN; (+) strand; PAM type: YTN; PAM sequence: CTG
ttgtctcagattcctgggtt

SEQ ID NO: 33023 - DNA, 20 bp, Artificial Sequence
  Description of Artificial Sequence: Synthetic oligonucleotide
  Target: FXN; (+) strand; PAM type: YTN; PAM sequence: TTG
tctcagattcctgggttcaa

SEQ ID NO: 33024 - DNA, 20 bp, Artificial Sequence
  Description of Artificial Sequence: Synthetic oligonucleotide
  Target: FXN; (+) strand; PAM type: YTN; PAM sequence: CTC
agattcctgggttcaagtga

SEQ ID NO: 33025 - DNA, 20 bp, Artificial Sequence
  Description of Artificial Sequence: Synthetic oligonucleotide
  Target: FXN; (+) strand; PAM type: YTN; PAM sequence: TTC
ctgggttcaagtgatccttc

SEQ ID NO: 33026 - DNA, 20 bp, Artificial Sequence
  Description of Artificial Sequence: Synthetic oligonucleotide
  Target: FXN; (+) strand; PAM type: YTN; PAM sequence: CTG
ggttcaagtgatccttctcc

SEQ ID NO: 33027 - DNA, 20 bp, Artificial Sequence
  Description of Artificial Sequence: Synthetic oligonucleotide
  Target: FXN; (+) strand; PAM type: YTN; PAM sequence: TTC
aagtgatccttctcccttgg

SEQ ID NO: 33028 - DNA, 20 bp, Artificial Sequence
  Description of Artificial Sequence: Synthetic oligonucleotide
  Target: FXN; (+) strand; PAM type: YTN; PAM sequence: CTT
ctcccttggcctcccaaagt

SEQ ID NO: 33029 - DNA, 20 bp, Artificial Sequence
  Description of Artificial Sequence: Synthetic oligonucleotide
  Target: FXN; (+) strand; PAM type: YTN; PAM sequence: TTC
tcccttggcctcccaaagtt

SEQ ID NO: 33030 - DNA, 20 bp, Artificial Sequence
  Description of Artificial Sequence: Synthetic oligonucleotide
  Target: FXN; (+) strand; PAM type: YTN; PAM sequence: CTC
ccttggcctcccaaagttct

SEQ ID NO: 33031 - DNA, 20 bp, Artificial Sequence
  Description of Artificial Sequence: Synthetic oligonucleotide
  Target: FXN; (+) strand; PAM type: YTN; PAM sequence: CTT
ggcctcccaaagttctggta

SEQ ID NO: 33032 - DNA, 20 bp, Artificial Sequence
  Description of Artificial Sequence: Synthetic oligonucleotide
  Target: FXN; (+) strand; PAM type: YTN; PAM sequence: TTG
gcctcccaaagttctggtat

SEQ ID NO: 33033 - DNA, 20 bp, Artificial Sequence
  Description of Artificial Sequence: Synthetic oligonucleotide
  Target: FXN; (+) strand; PAM type: YTN; PAM sequence: CTC
ccaaagttctggtattacag

SEQ ID NO: 33034 - DNA, 20 bp, Artificial Sequence
  Description of Artificial Sequence: Synthetic oligonucleotide
  Target: FXN; (+) strand; PAM type: YTN; PAM sequence: TTC
tggtattacaggcatgagcc

SEQ ID NO: 33035 - DNA, 20 bp, Artificial Sequence
  Description of Artificial Sequence: Synthetic oligonucleotide
  Target: FXN; (+) strand; PAM type: YTN; PAM sequence: CTG
gtattacaggcatgagccac

SEQ ID NO: 33036 - DNA, 20 bp, Artificial Sequence
  Description of Artificial Sequence: Synthetic oligonucleotide
  Target: FXN; (+) strand; PAM type: YTN; PAM sequence: TTA
caggcatgagccactgcacc

SEQ ID NO: 33037 - DNA, 20 bp, Artificial Sequence
  Description of Artificial Sequence: Synthetic oligonucleotide
  Target: FXN; (+) strand; PAM type: YTN; PAM sequence: CTG
cacccagcccatggccagct

SEQ ID NO: 33038 - DNA, 20 bp, Artificial Sequence
  Description of Artificial Sequence: Synthetic oligonucleotide
  Target: FXN; (+) strand; PAM type: YTN; PAM sequence: CTC
ttgatacgatctgtctcttt

SEQ ID NO: 33039 - DNA, 20 bp, Artificial Sequence
  Description of Artificial Sequence: Synthetic oligonucleotide
  Target: FXN; (+) strand; PAM type: YTN; PAM sequence: CTT
gatacgatctgtctctttct

SEQ ID NO: 33040 - DNA, 20 bp, Artificial Sequence
  Description of Artificial Sequence: Synthetic oligonucleotide
  Target: FXN; (+) strand; PAM type: YTN; PAM sequence: TTG
atacgatctgtctctttctt

SEQ ID NO: 33041 - DNA, 20 bp, Artificial Sequence
  Description of Artificial Sequence: Synthetic oligonucleotide
  Target: FXN; (+) strand; PAM type: YTN; PAM sequence: CTG
tctctttcttttcttttttt

SEQ ID NO: 33042 - DNA, 20 bp, Artificial Sequence
  Description of Artificial Sequence: Synthetic oligonucleotide
  Target: FXN; (+) strand; PAM type: YTN; PAM sequence: CTC
tttcttttcttttttttttt

SEQ ID NO: 33043 - DNA, 20 bp, Artificial Sequence
  Description of Artificial Sequence: Synthetic oligonucleotide
  Target: FXN; (+) strand; PAM type: YTN; PAM sequence: CTT
tcttttcttttttttttttt

SEQ ID NO: 33044 - DNA, 20 bp, Artificial Sequence
  Description of Artificial Sequence: Synthetic oligonucleotide
  Target: FXN; (+) strand; PAM type: YTN; PAM sequence: TTT
cttttcttttttttttttta

SEQ ID NO: 33045 - DNA, 20 bp, Artificial Sequence
  Description of Artificial Sequence: Synthetic oligonucleotide
  Target: FXN; (+) strand; PAM type: YTN; PAM sequence: TTC
ttttctttttttttttttaa

SEQ ID NO: 33046 - DNA, 20 bp, Artificial Sequence
  Description of Artificial Sequence: Synthetic oligonucleotide
  Target: FXN; (+) strand; PAM type: YTN; PAM sequence: CTT
ttctttttttttttttaatt

SEQ ID NO: 33047 - DNA, 20 bp, Artificial Sequence
  Description of Artificial Sequence: Synthetic oligonucleotide
  Target: FXN; (+) strand; PAM type: YTN; PAM sequence: TTT
tctttttttttttttaattt

SEQ ID NO: 33048 - DNA, 20 bp, Artificial Sequence
  Description of Artificial Sequence: Synthetic oligonucleotide
  Target: FXN; (+) strand; PAM type: YTN; PAM sequence: TTT
ctttttttttttttaatttg

SEQ ID NO: 33049 - DNA, 20 bp, Artificial Sequence
  Description of Artificial Sequence: Synthetic oligonucleotide
  Target: FXN; (+) strand; PAM type: YTN; PAM sequence: TTC
tttttttttttttaatttga

SEQ ID NO: 33050 - DNA, 20 bp, Artificial Sequence
  Description of Artificial Sequence: Synthetic oligonucleotide
  Target: FXN; (+) strand; PAM type: YTN; PAM sequence: CTT
tttttttttttaatttgaga

SEQ ID NO: 33051 - DNA, 20 bp, Artificial Sequence
  Description of Artificial Sequence: Synthetic oligonucleotide
  Target: FXN; (+) strand; PAM type: YTN; PAM sequence: TTT
ttttttttttaatttgagaa

SEQ ID NO: 33052 - DNA, 20 bp, Artificial Sequence
  Description of Artificial Sequence: Synthetic oligonucleotide
  Target: FXN; (+) strand; PAM type: YTN; PAM sequence: TTT
tttttttttaatttgagaag

SEQ ID NO: 33053 - DNA, 20 bp, Artificial Sequence
  Description of Artificial Sequence: Synthetic oligonucleotide
  Target: FXN; (+) strand; PAM type: YTN; PAM sequence: TTT
ttttttttaatttgagaagt

SEQ ID NO: 33054 - DNA, 20 bp, Artificial Sequence
  Description of Artificial Sequence: Synthetic oligonucleotide
  Target: FXN; (+) strand; PAM type: YTN; PAM sequence: TTT
tttttttaatttgagaagtg

SEQ ID NO: 33055 - DNA, 20 bp, Artificial Sequence
  Description of Artificial Sequence: Synthetic oligonucleotide
  Target: FXN; (+) strand; PAM type: YTN; PAM sequence: TTT
ttttttaatttgagaagtgt

SEQ ID NO: 33056 - DNA, 20 bp, Artificial Sequence
  Description of Artificial Sequence: Synthetic oligonucleotide
  Target: FXN; (+) strand; PAM type: YTN; PAM sequence: TTT
tttttaatttgagaagtgtt

SEQ ID NO: 33057 - DNA, 20 bp, Artificial Sequence
  Description of Artificial Sequence: Synthetic oligonucleotide
  Target: FXN; (+) strand; PAM type: YTN; PAM sequence: TTT
ttttaatttgagaagtgtta

SEQ ID NO: 33058 - DNA, 20 bp, Artificial Sequence
  Description of Artificial Sequence: Synthetic oligonucleotide
  Target: FXN; (+) strand; PAM type: YTN; PAM sequence: TTT
tttaatttgagaagtgttaa

SEQ ID NO: 33059 - DNA, 20 bp, Artificial Sequence
  Description of Artificial Sequence: Synthetic oligonucleotide
  Target: FXN; (+) strand; PAM type: YTN; PAM sequence: TTT
ttaatttgagaagtgttaaa

SEQ ID NO: 33060 - DNA, 20 bp, Artificial Sequence
  Description of Artificial Sequence: Synthetic oligonucleotide
  Target: FXN; (+) strand; PAM type: YTN; PAM sequence: TTT
taatttgagaagtgttaaat

SEQ ID NO: 33061 - DNA, 20 bp, Artificial Sequence
  Description of Artificial Sequence: Synthetic oligonucleotide
  Target: FXN; (+) strand; PAM type: YTN; PAM sequence: TTT
aatttgagaagtgttaaata

SEQ ID NO: 33062 - DNA, 20 bp, Artificial Sequence
  Description of Artificial Sequence: Synthetic oligonucleotide
  Target: FXN; (+) strand; PAM type: YTN; PAM sequence: TTA
atttgagaagtgttaaataa

SEQ ID NO: 33063 - DNA, 20 bp, Artificial Sequence
  Description of Artificial Sequence: Synthetic oligonucleotide
  Target: FXN; (+) strand; PAM type: YTN; PAM sequence: TTT
gagaagtgttaaataatctt

SEQ ID NO: 33064 - DNA, 20 bp, Artificial Sequence
  Description of Artificial Sequence: Synthetic oligonucleotide
  Target: FXN; (+) strand; PAM type: YTN; PAM sequence: TTG
agaagtgttaaataatcttt

SEQ ID NO: 33065 - DNA, 20 bp, Artificial Sequence
  Description of Artificial Sequence: Synthetic oligonucleotide
  Target: FXN; (+) strand; PAM type: YTN; PAM sequence: TTA
aataatctttctttgatatt

SEQ ID NO: 33066 - DNA, 20 bp, Artificial Sequence
  Description of Artificial Sequence: Synthetic oligonucleotide
  Target: FXN; (+) strand; PAM type: YTN; PAM sequence: CTT
tctttgatattatacataaa

SEQ ID NO: 33067 - DNA, 20 bp, Artificial Sequence
  Description of Artificial Sequence: Synthetic oligonucleotide
  Target: FXN; (+) strand; PAM type: YTN; PAM sequence: TTT
ctttgatattatacataaac

SEQ ID NO: 33068 - DNA, 20 bp, Artificial Sequence
  Description of Artificial Sequence: Synthetic oligonucleotide
  Target: FXN; (+) strand; PAM type: YTN; PAM sequence: TTC
tttgatattatacataaacc

SEQ ID NO: 33069 - DNA, 20 bp, Artificial Sequence
  Description of Artificial Sequence: Synthetic oligonucleotide
  Target: FXN; (+) strand; PAM type: YTN; PAM sequence: CTT
tgatattatacataaaccac

SEQ ID NO: 33070 - DNA, 20 bp, Artificial Sequence
  Description of Artificial Sequence: Synthetic oligonucleotide
  Target: FXN; (+) strand; PAM type: YTN; PAM sequence: TTT
gatattatacataaaccaca

SEQ ID NO: 33071 - DNA, 20 bp, Artificial Sequence
  Description of Artificial Sequence: Synthetic oligonucleotide
  Target: FXN; (+) strand; PAM type: YTN; PAM sequence: TTG
atattatacataaaccacac

SEQ ID NO: 33072 - DNA, 20 bp, Artificial Sequence
  Description of Artificial Sequence: Synthetic oligonucleotide
  Target: FXN; (+) strand; PAM type: YTN; PAM sequence: TTA
tacataaaccacaccaaaat

SEQ ID NO: 33073 - DNA, 20 bp, Artificial Sequence
  Description of Artificial Sequence: Synthetic oligonucleotide
  Target: FXN; (+) strand; PAM type: YTN; PAM sequence: CTT
tcagtaagtaaaatgaacca

SEQ ID NO: 33074 - DNA, 20 bp, Artificial Sequence
  Description of Artificial Sequence: Synthetic oligonucleotide
  Target: FXN; (+) strand; PAM type: YTN; PAM sequence: TTT
cagtaagtaaaatgaaccat

SEQ ID NO: 33075 - DNA, 20 bp, Artificial Sequence
  Description of Artificial Sequence: Synthetic oligonucleotide
  Target: FXN; (+) strand; PAM type: YTN; PAM sequence: TTC
agtaagtaaaatgaaccatt

SEQ ID NO: 33076 - DNA, 20 bp, Artificial Sequence
  Description of Artificial Sequence: Synthetic oligonucleotide
  Target: FXN; (+) strand; PAM type: YTN; PAM sequence: TTT
tagatacagaaaattctaat

SEQ ID NO: 33077 - DNA, 20 bp, Artificial Sequence
  Description of Artificial Sequence: Synthetic oligonucleotide
  Target: FXN; (+) strand; PAM type: YTN; PAM sequence: TTT
agatacagaaaattctaatt

SEQ ID NO: 33078 - DNA, 20 bp, Artificial Sequence
  Description of Artificial Sequence: Synthetic oligonucleotide
  Target: FXN; (+) strand; PAM type: YTN; PAM sequence: TTA
gatacagaaaattctaatta

SEQ ID NO: 33079 - DNA, 20 bp, Artificial Sequence
  Description of Artificial Sequence: Synthetic oligonucleotide
  Target: FXN; (+) strand; PAM type: YTN; PAM sequence: TTC
taattagattggcatagtta

SEQ ID NO: 33080 - DNA, 20 bp, Artificial Sequence
  Description of Artificial Sequence: Synthetic oligonucleotide
  Target: FXN; (+) strand; PAM type: YTN; PAM sequence: CTA
attagattggcatagttaag

SEQ ID NO: 33081 - DNA, 20 bp, Artificial Sequence
  Description of Artificial Sequence: Synthetic oligonucleotide
  Target: FXN; (+) strand; PAM type: YTN; PAM sequence: TTA
gattggcatagttaaggcca

SEQ ID NO: 33082 - DNA, 20 bp, Artificial Sequence
  Description of Artificial Sequence: Synthetic oligonucleotide
  Target: FXN; (+) strand; PAM type: YTN; PAM sequence: TTG
gcatagttaaggccaaaaat

SEQ ID NO: 33083 - DNA, 20 bp, Artificial Sequence
  Description of Artificial Sequence: Synthetic oligonucleotide
  Target: FXN; (+) strand; PAM type: YTN; PAM sequence: TTA
aggccaaaaatataaagttg

SEQ ID NO: 33084 - DNA, 20 bp, Artificial Sequence
  Description of Artificial Sequence: Synthetic oligonucleotide
  Target: FXN; (+) strand; PAM type: YTN; PAM sequence: TTG
acattgctaccttatcttca

SEQ ID NO: 33085 - DNA, 20 bp, Artificial Sequence
  Description of Artificial Sequence: Synthetic oligonucleotide
  Target: FXN; (+) strand; PAM type: YTN; PAM sequence: TTG
ctaccttatcttcagccctt

SEQ ID NO: 33086 - DNA, 20 bp, Artificial Sequence
  Description of Artificial Sequence: Synthetic oligonucleotide
  Target: FXN; (+) strand; PAM type: YTN; PAM sequence: CTA
ccttatcttcagcccttgcc

SEQ ID NO: 33087 - DNA, 20 bp, Artificial Sequence
  Description of Artificial Sequence: Synthetic oligonucleotide
  Target: FXN; (+) strand; PAM type: YTN; PAM sequence: CTT
atcttcagcccttgccttta

SEQ ID NO: 33088 - DNA, 20 bp, Artificial Sequence
  Description of Artificial Sequence: Synthetic oligonucleotide
  Target: FXN; (+) strand; PAM type: YTN; PAM sequence: TTA
tcttcagcccttgcctttaa

SEQ ID NO: 33089 - DNA, 20 bp, Artificial Sequence
  Description of Artificial Sequence: Synthetic oligonucleotide
  Target: FXN; (+) strand; PAM type: YTN; PAM sequence: CTT
cagcccttgcctttaagagg

SEQ ID NO: 33090 - DNA, 20 bp, Artificial Sequence
  Description of Artificial Sequence: Synthetic oligonucleotide
  Target: FXN; (+) strand; PAM type: YTN; PAM sequence: TTC
agcccttgcctttaagaggc

SEQ ID NO: 33091 - DNA, 20 bp, Artificial Sequence
  Description of Artificial Sequence: Synthetic oligonucleotide
  Target: FXN; (+) strand; PAM type: YTN; PAM sequence: CTT
gcctttaagaggcaaatgaa

SEQ ID NO: 33092 - DNA, 20 bp, Artificial Sequence
  Description of Artificial Sequence: Synthetic oligonucleotide
  Target: FXN; (+) strand; PAM type: YTN; PAM sequence: TTG
cctttaagaggcaaatgaac

SEQ ID NO: 33093 - DNA, 20 bp, Artificial Sequence
  Description of Artificial Sequence: Synthetic oligonucleotide
  Target: FXN; (+) strand; PAM type: YTN; PAM sequence: CTT
taagaggcaaatgaacacaa

SEQ ID NO: 33094 - DNA, 20 bp, Artificial Sequence
  Description of Artificial Sequence: Synthetic oligonucleotide
  Target: FXN; (+) strand; PAM type: YTN; PAM sequence: TTT
aagaggcaaatgaacacaaa

SEQ ID NO: 33095 - DNA, 20 bp, Artificial Sequence
  Description of Artificial Sequence: Synthetic oligonucleotide
  Target: FXN; (+) strand; PAM type: YTN; PAM sequence: TTA
agaggcaaatgaacacaaaa

SEQ ID NO: 33096 - DNA, 20 bp, Artificial Sequence
  Description of Artificial Sequence: Synthetic oligonucleotide
  Target: FXN; (+) strand; PAM type: YTN; PAM sequence: CTT
gcttggttctgagacagtga

SEQ ID NO: 33097 - DNA, 20 bp, Artificial Sequence
  Description of Artificial Sequence: Synthetic oligonucleotide
  Target: FXN; (+) strand; PAM type: YTN; PAM sequence: TTG
cttggttctgagacagtgaa

SEQ ID NO: 33098 - DNA, 20 bp, Artificial Sequence
  Description of Artificial Sequence: Synthetic oligonucleotide
  Target: FXN; (+) strand; PAM type: YTN; PAM sequence: CTT
ggttctgagacagtgaagga

SEQ ID NO: 33099 - DNA, 20 bp, Artificial Sequence
  Description of Artificial Sequence: Synthetic oligonucleotide
  Target: FXN; (+) strand; PAM type: YTN; PAM sequence: TTG
gttctgagacagtgaaggac

SEQ ID NO: 33100 - DNA, 20 bp, Artificial Sequence
  Description of Artificial Sequence: Synthetic oligonucleotide
  Target: FXN; (+) strand; PAM type: YTN; PAM sequence: TTC
tgagacagtgaaggactttc

SEQ ID NO: 33101 - DNA, 20 bp, Artificial Sequence
  Description of Artificial Sequence: Synthetic oligonucleotide
  Target: FXN; (+) strand; PAM type: YTN; PAM sequence: CTG
agacagtgaaggactttccc

SEQ ID NO: 33102 - DNA, 20 bp, Artificial Sequence
  Description of Artificial Sequence: Synthetic oligonucleotide
  Target: FXN; (+) strand; PAM type: YTN; PAM sequence: CTT
tcccccagtatttaaatata

SEQ ID NO: 33103 - DNA, 20 bp, Artificial Sequence
  Description of Artificial Sequence: Synthetic oligonucleotide
  Target: FXN; (+) strand; PAM type: YTN; PAM sequence: TTT
cccccagtatttaaatatat

SEQ ID NO: 33104 - DNA, 20 bp, Artificial Sequence
  Description of Artificial Sequence: Synthetic oligonucleotide
  Target: FXN; (+) strand; PAM type: YTN; PAM sequence: TTC
ccccagtatttaaatatatt

SEQ ID NO: 33105 - DNA, 20 bp, Artificial Sequence
  Description of Artificial Sequence: Synthetic oligonucleotide
  Target: FXN; (+) strand; PAM type: YTN; PAM sequence: TTT
aaatatatttacataaccag

SEQ ID NO: 33106 - DNA, 20 bp, Artificial Sequence
  Description of Artificial Sequence: Synthetic oligonucleotide
  Target: FXN; (+) strand; PAM type: YTN; PAM sequence: TTA
aatatatttacataaccagt

SEQ ID NO: 33107 - DNA, 20 bp, Artificial Sequence
  Description of Artificial Sequence: Synthetic oligonucleotide
  Target: FXN; (+) strand; PAM type: YTN; PAM sequence: TTT
acataaccagttacataaat

SEQ ID NO: 33108 - DNA, 20 bp, Artificial Sequence
  Description of Artificial Sequence: Synthetic oligonucleotide
  Target: FXN; (+) strand; PAM type: YTN; PAM sequence: TTA
cataaccagttacataaatc

SEQ ID NO: 33109 - DNA, 20 bp, Artificial Sequence
  Description of Artificial Sequence: Synthetic oligonucleotide
  Target: FXN; (+) strand; PAM type: YTN; PAM sequence: TTA
cataaatctaaatattaaaa

SEQ ID NO: 33110 - DNA, 20 bp, Artificial Sequence
  Description of Artificial Sequence: Synthetic oligonucleotide
  Target: FXN; (+) strand; PAM type: YTN; PAM sequence: CTA
aatattaaaaaaatctccaa

SEQ ID NO: 33111 - DNA, 20 bp, Artificial Sequence
  Description of Artificial Sequence: Synthetic oligonucleotide
  Target: FXN; (+) strand; PAM type: YTN; PAM sequence: TTA
aaaaaatctccaatagattt

SEQ ID NO: 33112 - DNA, 20 bp, Artificial Sequence
  Description of Artificial Sequence: Synthetic oligonucleotide
  Target: FXN; (+) strand; PAM type: YTN; PAM sequence: CTC
caatagattttagatggcat

SEQ ID NO: 33113 - DNA, 20 bp, Artificial Sequence
  Description of Artificial Sequence: Synthetic oligonucleotide
  Target: FXN; (+) strand; PAM type: YTN; PAM sequence: TTT
tagatggcattcaccatctt

SEQ ID NO: 33114 - DNA, 20 bp, Artificial Sequence
  Description of Artificial Sequence: Synthetic oligonucleotide
  Target: FXN; (+) strand; PAM type: YTN; PAM sequence: TTT
agatggcattcaccatcttt

SEQ ID NO: 33115 - DNA, 20 bp, Artificial Sequence
  Description of Artificial Sequence: Synthetic oligonucleotide
  Target: FXN; (+) strand; PAM type: YTN; PAM sequence: TTA
gatggcattcaccatctttg

SEQ ID NO: 33116 - DNA, 20 bp, Artificial Sequence
  Description of Artificial Sequence: Synthetic oligonucleotide
  Target: FXN; (+) strand; PAM type: YTN; PAM sequence: TTC
accatctttgtgaaaagttg

SEQ ID NO: 33117 - DNA, 20 bp, Artificial Sequence
  Description of Artificial Sequence: Synthetic oligonucleotide
  Target: FXN; (+) strand; PAM type: YTN; PAM sequence: CTT
tgtgaaaagttgaacattac

SEQ ID NO: 33118 - DNA, 20 bp, Artificial Sequence
  Description of Artificial Sequence: Synthetic oligonucleotide
  Target: FXN; (+) strand; PAM type: YTN; PAM sequence: TTT
gtgaaaagttgaacattact

SEQ ID NO: 33119 - DNA, 20 bp, Artificial Sequence
  Description of Artificial Sequence: Synthetic oligonucleotide
  Target: FXN; (+) strand; PAM type: YTN; PAM sequence: TTG
tgaaaagttgaacattacta

SEQ ID NO: 33120 - DNA, 20 bp, Artificial Sequence
  Description of Artificial Sequence: Synthetic oligonucleotide
  Target: FXN; (+) strand; PAM type: YTN; PAM sequence: TTG
aacattactaatgaaatctg

SEQ ID NO: 33121 - DNA, 20 bp, Artificial Sequence
  Description of Artificial Sequence: Synthetic oligonucleotide
  Target: FXN; (+) strand; PAM type: YTN; PAM sequence: TTA
ctaatgaaatctgatcatat

SEQ ID NO: 33122 - DNA, 20 bp, Artificial Sequence
  Description of Artificial Sequence: Synthetic oligonucleotide
  Target: FXN; (+) strand; PAM type: YTN; PAM sequence: CTA
atgaaatctgatcatatctt

SEQ ID NO: 33123 - DNA, 20 bp, Artificial Sequence
  Description of Artificial Sequence: Synthetic oligonucleotide
  Target: FXN; (+) strand; PAM type: YTN; PAM sequence: CTG
atcatatctttagaaggata

SEQ ID NO: 33124 - DNA, 20 bp, Artificial Sequence
  Description of Artificial Sequence: Synthetic oligonucleotide
  Target: FXN; (+) strand; PAM type: YTN; PAM sequence: CTT
tagaaggataaacagtgata

SEQ ID NO: 33125 - DNA, 20 bp, Artificial Sequence
  Description of Artificial Sequence: Synthetic oligonucleotide
  Target: FXN; (+) strand; PAM type: YTN; PAM sequence: TTT
agaaggataaacagtgatag

SEQ ID NO: 33126 - DNA, 20 bp, Artificial Sequence
  Description of Artificial Sequence: Synthetic oligonucleotide
  Target: FXN; (+) strand; PAM type: YTN; PAM sequence: TTA
gaaggataaacagtgatagc

SEQ ID NO: 33127 - DNA, 20 bp, Artificial Sequence
  Description of Artificial Sequence: Synthetic oligonucleotide
  Target: FXN; (+) strand; PAM type: YTN; PAM sequence: TTT
actgaatcagaataactgtt

SEQ ID NO: 33128 - DNA, 20 bp, Artificial Sequence
  Description of Artificial Sequence: Synthetic oligonucleotide
  Target: FXN; (+) strand; PAM type: YTN; PAM sequence: TTA
ctgaatcagaataactgttt

SEQ ID NO: 33129 - DNA, 20 bp, Artificial Sequence
  Description of Artificial Sequence: Synthetic oligonucleotide
  Target: FXN; (+) strand; PAM type: YTN; PAM sequence: CTG
aatcagaataactgtttttt

SEQ ID NO: 33130 - DNA, 20 bp, Artificial Sequence
  Description of Artificial Sequence: Synthetic oligonucleotide
  Target: FXN; (+) strand; PAM type: YTN; PAM sequence: CTG
ttttttggggttttctttga

SEQ ID NO: 33131 - DNA, 20 bp, Artificial Sequence
  Description of Artificial Sequence: Synthetic oligonucleotide
  Target: FXN; (+) strand; PAM type: YTN; PAM sequence: TTT
tttggggttttctttgagac

SEQ ID NO: 33132 - DNA, 20 bp, Artificial Sequence
  Description of Artificial Sequence: Synthetic oligonucleotide
  Target: FXN; (+) strand; PAM type: YTN; PAM sequence: TTT
ttggggttttctttgagacg

SEQ ID NO: 33133 - DNA, 20 bp, Artificial Sequence
  Description of Artificial Sequence: Synthetic oligonucleotide
  Target: FXN; (+) strand; PAM type: YTN; PAM sequence: TTT
tggggttttctttgagacgg

SEQ ID NO: 33134 - DNA, 20 bp, Artificial Sequence
  Description of Artificial Sequence: Synthetic oligonucleotide
  Target: FXN; (+) strand; PAM type: YTN; PAM sequence: TTT
ggggttttctttgagacgga

SEQ ID NO: 33135 - DNA, 20 bp, Artificial Sequence
  Description of Artificial Sequence: Synthetic oligonucleotide
  Target: FXN; (+) strand; PAM type: YTN; PAM sequence: TTG
gggttttctttgagacggag

SEQ ID NO: 33136 - DNA, 20 bp, Artificial Sequence
  Description of Artificial Sequence: Synthetic oligonucleotide
  Target: FXN; (+) strand; PAM type: YTN; PAM sequence: TTT
tctttgagacggagttttgc

SEQ ID NO: 33137 - DNA, 20 bp, Artificial Sequence
  Description of Artificial Sequence: Synthetic oligonucleotide
  Target: FXN; (+) strand; PAM type: YTN; PAM sequence: TTT
ctttgagacggagttttgct

SEQ ID NO: 33138 - DNA, 20 bp, Artificial Sequence
  Description of Artificial Sequence: Synthetic oligonucleotide
  Target: FXN; (+) strand; PAM type: YTN; PAM sequence: TTC
tttgagacggagttttgctc

SEQ ID NO: 33139 - DNA, 20 bp, Artificial Sequence
  Description of Artificial Sequence: Synthetic oligonucleotide
  Target: FXN; (+) strand; PAM type: YTN; PAM sequence: CTT
tgagacggagttttgctctt

SEQ ID NO: 33140 - DNA, 20 bp, Artificial Sequence
  Description of Artificial Sequence: Synthetic oligonucleotide
  Target: FXN; (+) strand; PAM type: YTN; PAM sequence: TTT
gagacggagttttgctcttg

SEQ ID NO: 33141 - DNA, 20 bp, Artificial Sequence
  Description of Artificial Sequence: Synthetic oligonucleotide
  Target: FXN; (+) strand; PAM type: YTN; PAM sequence: TTG
agacggagttttgctcttgt

SEQ ID NO: 33142 - DNA, 20 bp, Artificial Sequence
  Description of Artificial Sequence: Synthetic oligonucleotide
  Target: FXN; (+) strand; PAM type: YTN; PAM sequence: TTT
tgctcttgttgcccaggctg

SEQ ID NO: 33143 - DNA, 20 bp, Artificial Sequence
  Description of Artificial Sequence: Synthetic oligonucleotide
  Target: FXN; (+) strand; PAM type: YTN; PAM sequence: TTT
gctcttgttgcccaggctgg

SEQ ID NO: 33144 - DNA, 20 bp, Artificial Sequence
  Description of Artificial Sequence: Synthetic oligonucleotide
  Target: FXN; (+) strand; PAM type: YTN; PAM sequence: TTG
ctcttgttgcccaggctgga

SEQ ID NO: 33145 - DNA, 20 bp, Artificial Sequence
  Description of Artificial Sequence: Synthetic oligonucleotide
  Target: FXN; (+) strand; PAM type: YTN; PAM sequence: CTC
ttgttgcccaggctggagtg

SEQ ID NO: 33146 - DNA, 20 bp, Artificial Sequence
  Description of Artificial Sequence: Synthetic oligonucleotide
  Target: FXN; (+) strand; PAM type: YTN; PAM sequence: CTT
gttgcccaggctggagtgca

SEQ ID NO: 33147 - DNA, 20 bp, Artificial Sequence
  Description of Artificial Sequence: Synthetic oligonucleotide
  Target: FXN; (+) strand; PAM type: YTN; PAM sequence: TTG
ttgcccaggctggagtgcag

SEQ ID NO: 33148 - DNA, 20 bp, Artificial Sequence
  Description of Artificial Sequence: Synthetic oligonucleotide
  Target: FXN; (+) strand; PAM type: YTN; PAM sequence: TTG
cccaggctggagtgcagtgg

SEQ ID NO: 33149 - DNA, 20 bp, Artificial Sequence
  Description of Artificial Sequence: Synthetic oligonucleotide
  Target: FXN; (+) strand; PAM type: YTN; PAM sequence: CTG
gagtgcagtggtgccacctc

SEQ ID NO: 33150 - DNA, 20 bp, Artificial Sequence
  Description of Artificial Sequence: Synthetic oligonucleotide
  Target: FXN; (+) strand; PAM type: YTN; PAM sequence: CTC
agctcactgcaacctccgcc

SEQ ID NO: 33151 - DNA, 20 bp, Artificial Sequence
  Description of Artificial Sequence: Synthetic oligonucleotide
  Target: FXN; (+) strand; PAM type: YTN; PAM sequence: CTC
actgcaacctccgccccctg

SEQ ID NO: 33152 - DNA, 20 bp, Artificial Sequence
  Description of Artificial Sequence: Synthetic oligonucleotide
  Target: FXN; (+) strand; PAM type: YTN; PAM sequence: CTG
caacctccgccccctggatt

SEQ ID NO: 33153 - DNA, 20 bp, Artificial Sequence
  Description of Artificial Sequence: Synthetic oligonucleotide
  Target: FXN; (+) strand; PAM type: YTN; PAM sequence: CTC
cgccccctggattcaagaga

SEQ ID NO: 33154 - DNA, 20 bp, Artificial Sequence
  Description of Artificial Sequence: Synthetic oligonucleotide
  Target: FXN; (+) strand; PAM type: YTN; PAM sequence: CTG
gattcaagagattatcctgc

SEQ ID NO: 33155 - DNA, 20 bp, Artificial Sequence
  Description of Artificial Sequence: Synthetic oligonucleotide
  Target: FXN; (+) strand; PAM type: YTN; PAM sequence: TTC
aagagattatcctgcctcag

SEQ ID NO: 33156 - DNA, 20 bp, Artificial Sequence
  Description of Artificial Sequence: Synthetic oligonucleotide
  Target: FXN; (+) strand; PAM type: YTN; PAM sequence: TTA
tcctgcctcagcctcccgag

SEQ ID NO: 33157 - DNA, 20 bp, Artificial Sequence
  Description of Artificial Sequence: Synthetic oligonucleotide
  Target: FXN; (+) strand; PAM type: YTN; PAM sequence: CTG
cctcagcctcccgagtagct

SEQ ID NO: 33158 - DNA, 20 bp, Artificial Sequence
  Description of Artificial Sequence: Synthetic oligonucleotide
  Target: FXN; (+) strand; PAM type: YTN; PAM sequence: CTC
agcctcccgagtagctggga

SEQ ID NO: 33159 - DNA, 20 bp, Artificial Sequence
  Description of Artificial Sequence: Synthetic oligonucleotide
  Target: FXN; (+) strand; PAM type: YTN; PAM sequence: CTC
ccgagtagctgggattacag

SEQ ID NO: 33160 - DNA, 20 bp, Artificial Sequence
  Description of Artificial Sequence: Synthetic oligonucleotide
  Target: FXN; (+) strand; PAM type: YTN; PAM sequence: CTG
ggattacaggctcgccccac

SEQ ID NO: 33161 - DNA, 20 bp, Artificial Sequence
  Description of Artificial Sequence: Synthetic oligonucleotide
  Target: FXN; (+) strand; PAM type: YTN; PAM sequence: TTA
caggctcgccccaccatgcc

SEQ ID NO: 33162 - DNA, 20 bp, Artificial Sequence
  Description of Artificial Sequence: Synthetic oligonucleotide
  Target: FXN; (+) strand; PAM type: YTN; PAM sequence: CTC
gccccaccatgcccagctaa

SEQ ID NO: 33163 - DNA, 20 bp, Artificial Sequence
  Description of Artificial Sequence: Synthetic oligonucleotide
  Target: FXN; (+) strand; PAM type: YTN; PAM sequence: CTA
atttttgtatttttagtaga

SEQ ID NO: 33164 - DNA, 20 bp, Artificial Sequence
  Description of Artificial Sequence: Synthetic oligonucleotide
  Target: FXN; (+) strand; PAM type: YTN; PAM sequence: TTT
ttgtatttttagtagaggcg

SEQ ID NO: 33165 - DNA, 20 bp, Artificial Sequence
  Description of Artificial Sequence: Synthetic oligonucleotide
  Target: FXN; (+) strand; PAM type: YTN; PAM sequence: TTT
tgtatttttagtagaggcga

SEQ ID NO: 33166 - DNA, 20 bp, Artificial Sequence
  Description of Artificial Sequence: Synthetic oligonucleotide
  Target: FXN; (+) strand; PAM type: YTN; PAM sequence: TTT
gtatttttagtagaggcgag

SEQ ID NO: 33167 - DNA, 20 bp, Artificial Sequence
  Description of Artificial Sequence: Synthetic oligonucleotide
  Target: FXN; (+) strand; PAM type: YTN; PAM sequence: TTG
tatttttagtagaggcgagg

SEQ ID NO: 33168 - DNA, 20 bp, Artificial Sequence
  Description of Artificial Sequence: Synthetic oligonucleotide
  Target: FXN; (+) strand; PAM type: YTN; PAM sequence: TTT
ttagtagaggcgaggtttca

SEQ ID NO: 33169 - DNA, 20 bp, Artificial Sequence
  Description of Artificial Sequence: Synthetic oligonucleotide
  Target: FXN; (+) strand; PAM type: YTN; PAM sequence: TTT
tagtagaggcgaggtttcac

SEQ ID NO: 33170 - DNA, 20 bp, Artificial Sequence
  Description of Artificial Sequence: Synthetic oligonucleotide
  Target: FXN; (+) strand; PAM type: YTN; PAM sequence: TTT
agtagaggcgaggtttcacc

SEQ ID NO: 33171 - DNA, 20 bp, Artificial Sequence
  Description of Artificial Sequence: Synthetic oligonucleotide
  Target: FXN; (+) strand; PAM type: YTN; PAM sequence: TTA
gtagaggcgaggtttcacca

SEQ ID NO: 33172 - DNA, 20 bp, Artificial Sequence
  Description of Artificial Sequence: Synthetic oligonucleotide
  Target: FXN; (+) strand; PAM type: YTN; PAM sequence: TTT
caccatgtcagccaggctgg

SEQ ID NO: 33173 - DNA, 20 bp, Artificial Sequence
  Description of Artificial Sequence: Synthetic oligonucleotide
  Target: FXN; (+) strand; PAM type: YTN; PAM sequence: TTC
accatgtcagccaggctggt

SEQ ID NO: 33174 - DNA, 20 bp, Artificial Sequence
  Description of Artificial Sequence: Synthetic oligonucleotide
  Target: FXN; (+) strand; PAM type: YTN; PAM sequence: CTG
gtcttgaactcctgacctca

SEQ ID NO: 33175 - DNA, 20 bp, Artificial Sequence
  Description of Artificial Sequence: Synthetic oligonucleotide
  Target: FXN; (+) strand; PAM type: YTN; PAM sequence: CTT
gaactcctgacctcaggtga

SEQ ID NO: 33176 - DNA, 20 bp, Artificial Sequence
  Description of Artificial Sequence: Synthetic oligonucleotide
  Target: FXN; (+) strand; PAM type: YTN; PAM sequence: TTG
aactcctgacctcaggtgat

SEQ ID NO: 33177 - DNA, 20 bp, Artificial Sequence
  Description of Artificial Sequence: Synthetic oligonucleotide
  Target: FXN; (+) strand; PAM type: YTN; PAM sequence: CTC
ctgacctcaggtgatccacc

SEQ ID NO: 33178 - DNA, 20 bp, Artificial Sequence
  Description of Artificial Sequence: Synthetic oligonucleotide
  Target: FXN; (+) strand; PAM type: YTN; PAM sequence: CTG
acctcaggtgatccacccgc

SEQ ID NO: 33179 - DNA, 20 bp, Artificial Sequence
  Description of Artificial Sequence: Synthetic oligonucleotide
  Target: FXN; (+) strand; PAM type: YTN; PAM sequence: CTC
aggtgatccacccgcctcag

SEQ ID NO: 33180 - DNA, 20 bp, Artificial Sequence
  Description of Artificial Sequence: Synthetic oligonucleotide
  Target: FXN; (+) strand; PAM type: YTN; PAM sequence: CTC
agcctcccaaaatgctagga

SEQ ID NO: 33181 - DNA, 20 bp, Artificial Sequence
  Description of Artificial Sequence: Synthetic oligonucleotide
  Target: FXN; (+) strand; PAM type: YTN; PAM sequence: CTC
ccaaaatgctaggattacag

SEQ ID NO: 33182 - DNA, 20 bp, Artificial Sequence
  Description of Artificial Sequence: Synthetic oligonucleotide
  Target: FXN; (+) strand; PAM type: YTN; PAM sequence: CTA
ggattacaggcgtgagccac

SEQ ID NO: 33183 - DNA, 20 bp, Artificial Sequence
  Description of Artificial Sequence: Synthetic oligonucleotide
  Target: FXN; (+) strand; PAM type: YTN; PAM sequence: TTA
caggcgtgagccaccaggcc

SEQ ID NO: 33184 - DNA, 20 bp, Artificial Sequence
  Description of Artificial Sequence: Synthetic oligonucleotide
  Target: FXN; (+) strand; PAM type: YTN; PAM sequence: CTA
ttttttttttttttcttttt

SEQ ID NO: 33185 - DNA, 20 bp, Artificial Sequence
  Description of Artificial Sequence: Synthetic oligonucleotide
  Target: FXN; (+) strand; PAM type: YTN; PAM sequence: TTT
tttttttttttctttttttg

SEQ ID NO: 33186 - DNA, 20 bp, Artificial Sequence
  Description of Artificial Sequence: Synthetic oligonucleotide
  Target: FXN; (+) strand; PAM type: YTN; PAM sequence: TTT
ttttttttttctttttttga

SEQ ID NO: 33187 - DNA, 20 bp, Artificial Sequence
  Description of Artificial Sequence: Synthetic oligonucleotide
  Target: FXN; (+) strand; PAM type: YTN; PAM sequence: TTT
tttttttttctttttttgag

SEQ ID NO: 33188 - DNA, 20 bp, Artificial Sequence
  Description of Artificial Sequence: Synthetic oligonucleotide
  Target: FXN; (+) strand; PAM type: YTN; PAM sequence: TTT
ttttttttctttttttgaga

SEQ ID NO: 33189 - DNA, 20 bp, Artificial Sequence
  Description of Artificial Sequence: Synthetic oligonucleotide
  Target: FXN; (+) strand; PAM type: YTN; PAM sequence: TTT
tttttttctttttttgagac

SEQ ID NO: 33190 - DNA, 20 bp, Artificial Sequence
  Description of Artificial Sequence: Synthetic oligonucleotide
  Target: FXN; (+) strand; PAM type: YTN; PAM sequence: TTT
ttttttctttttttgagacg

SEQ ID NO: 33191 - DNA, 20 bp, Artificial Sequence
  Description of Artificial Sequence: Synthetic oligonucleotide
  Target: FXN; (+) strand; PAM type: YTN; PAM sequence: TTT
tttttctttttttgagacgg

SEQ ID NO: 33192 - DNA, 20 bp, Artificial Sequence
  Description of Artificial Sequence: Synthetic oligonucleotide
  Target: FXN; (+) strand; PAM type: YTN; PAM sequence: TTT
ttttctttttttgagacgga

SEQ ID NO: 33193 - DNA, 20 bp, Artificial Sequence
  Description of Artificial Sequence: Synthetic oligonucleotide
  Target: FXN; (+) strand; PAM type: YTN; PAM sequence: TTT
tttctttttttgagacggag

SEQ ID NO: 33194 - DNA, 20 bp, Artificial Sequence
  Description of Artificial Sequence: Synthetic oligonucleotide
  Target: FXN; (+) strand; PAM type: YTN; PAM sequence: TTT
ttctttttttgagacggagt

SEQ ID NO: 33195 - DNA, 20 bp, Artificial Sequence
  Description of Artificial Sequence: Synthetic oligonucleotide
  Target: FXN; (+) strand; PAM type: YTN; PAM sequence: TTT
tctttttttgagacggagtc

SEQ ID NO: 33196 - DNA, 20 bp, Artificial Sequence
  Description of Artificial Sequence: Synthetic oligonucleotide
  Target: FXN; (+) strand; PAM type: YTN; PAM sequence: TTT
ctttttttgagacggagtct

SEQ ID NO: 33197 - DNA, 20 bp, Artificial Sequence
  Description of Artificial Sequence: Synthetic oligonucleotide
  Target: FXN; (+) strand; PAM type: YTN; PAM sequence: TTC
tttttttgagacggagtctc

SEQ ID NO: 33198 - DNA, 20 bp, Artificial Sequence
  Description of Artificial Sequence: Synthetic oligonucleotide
  Target: FXN; (+) strand; PAM type: YTN; PAM sequence: CTT
tttttgagacggagtctcac

SEQ ID NO: 33199 - DNA, 20 bp, Artificial Sequence
  Description of Artificial Sequence: Synthetic oligonucleotide
  Target: FXN; (+) strand; PAM type: YTN; PAM sequence: TTT
ttttgagacggagtctcact

SEQ ID NO: 33200 - DNA, 20 bp, Artificial Sequence
  Description of Artificial Sequence: Synthetic oligonucleotide
  Target: FXN; (+) strand; PAM type: YTN; PAM sequence: TTT
tttgagacggagtctcactc

SEQ ID NO: 33201 - DNA, 20 bp, Artificial Sequence
  Description of Artificial Sequence: Synthetic oligonucleotide
  Target: FXN; (+) strand; PAM type: YTN; PAM sequence: TTT
ttgagacggagtctcactct

SEQ ID NO: 33202 - DNA, 20 bp, Artificial Sequence
  Description of Artificial Sequence: Synthetic oligonucleotide
  Target: FXN; (+) strand; PAM type: YTN; PAM sequence: TTT
tgagacggagtctcactctg

SEQ ID NO: 33203 - DNA, 20 bp, Artificial Sequence
  Description of Artificial Sequence: Synthetic oligonucleotide
  Target: FXN; (+) strand; PAM type: YTN; PAM sequence: TTT
gagacggagtctcactctgt

SEQ ID NO: 33204 - DNA, 20 bp, Artificial Sequence
  Description of Artificial Sequence: Synthetic oligonucleotide
  Target: FXN; (+) strand; PAM type: YTN; PAM sequence: TTG
agacggagtctcactctgtc

SEQ ID NO: 33205 - DNA, 20 bp, Artificial Sequence
  Description of Artificial Sequence: Synthetic oligonucleotide
  Target: FXN; (+) strand; PAM type: YTN; PAM sequence: CTC
actctgtcacccaggctgga

SEQ ID NO: 33206 - DNA, 20 bp, Artificial Sequence
  Description of Artificial Sequence: Synthetic oligonucleotide
  Target: FXN; (+) strand; PAM type: YTN; PAM sequence: CTC
tgtcacccaggctggagtgc

SEQ ID NO: 33207 - DNA, 20 bp, Artificial Sequence
  Description of Artificial Sequence: Synthetic oligonucleotide
  Target: FXN; (+) strand; PAM type: YTN; PAM sequence: CTG
tcacccaggctggagtgcag

SEQ ID NO: 33208 - DNA, 20 bp, Artificial Sequence
  Description of Artificial Sequence: Synthetic oligonucleotide
  Target: FXN; (+) strand; PAM type: YTN; PAM sequence: CTG
gagtgcagtggcacaatgtc

SEQ ID NO: 33209 - DNA, 20 bp, Artificial Sequence
  Description of Artificial Sequence: Synthetic oligonucleotide
  Target: FXN; (+) strand; PAM type: YTN; PAM sequence: CTC
attgcaacctccacctccgg

SEQ ID NO: 33210 - DNA, 20 bp, Artificial Sequence
  Description of Artificial Sequence: Synthetic oligonucleotide
  Target: FXN; (+) strand; PAM type: YTN; PAM sequence: TTG
caacctccacctccggggtt

SEQ ID NO: 33211 - DNA, 20 bp, Artificial Sequence
  Description of Artificial Sequence: Synthetic oligonucleotide
  Target: FXN; (+) strand; PAM type: YTN; PAM sequence: CTC
cacctccggggtttcagtga

SEQ ID NO: 33212 - DNA, 20 bp, Artificial Sequence
  Description of Artificial Sequence: Synthetic oligonucleotide
  Target: FXN; (+) strand; PAM type: YTN; PAM sequence: CTC
cggggtttcagtgattctcc

SEQ ID NO: 33213 - DNA, 20 bp, Artificial Sequence
  Description of Artificial Sequence: Synthetic oligonucleotide
  Target: FXN; (+) strand; PAM type: YTN; PAM sequence: TTT
cagtgattctcctgtctcag

SEQ ID NO: 33214 - DNA, 20 bp, Artificial Sequence
  Description of Artificial Sequence: Synthetic oligonucleotide
  Target: FXN; (+) strand; PAM type: YTN; PAM sequence: TTC
agtgattctcctgtctcagc

SEQ ID NO: 33215 - DNA, 20 bp, Artificial Sequence
  Description of Artificial Sequence: Synthetic oligonucleotide
  Target: FXN; (+) strand; PAM type: YTN; PAM sequence: TTC
tcctgtctcagcctcccaag

SEQ ID NO: 33216 - DNA, 20 bp, Artificial Sequence
  Description of Artificial Sequence: Synthetic oligonucleotide
  Target: FXN; (+) strand; PAM type: YTN; PAM sequence: CTC
ctgtctcagcctcccaagta

SEQ ID NO: 33217 - DNA, 20 bp, Artificial Sequence
  Description of Artificial Sequence: Synthetic oligonucleotide
  Target: FXN; (+) strand; PAM type: YTN; PAM sequence: CTG
tctcagcctcccaagtagct

SEQ ID NO: 33218 - DNA, 20 bp, Artificial Sequence
  Description of Artificial Sequence: Synthetic oligonucleotide
  Target: FXN; (+) strand; PAM type: YTN; PAM sequence: CTC
agcctcccaagtagctggga

SEQ ID NO: 33219 - DNA, 20 bp, Artificial Sequence
  Description of Artificial Sequence: Synthetic oligonucleotide
  Target: FXN; (+) strand; PAM type: YTN; PAM sequence: CTC
ccaagtagctgggaactaca

SEQ ID NO: 33220 - DNA, 20 bp, Artificial Sequence
  Description of Artificial Sequence: Synthetic oligonucleotide
  Target: FXN; (+) strand; PAM type: YTN; PAM sequence: CTG
ggaactacaggcgtgcacca

SEQ ID NO: 33221 - DNA, 20 bp, Artificial Sequence
  Description of Artificial Sequence: Synthetic oligonucleotide
  Target: FXN; (+) strand; PAM type: YTN; PAM sequence: CTA
caggcgtgcaccacaagccc

SEQ ID NO: 33222 - DNA, 20 bp, Artificial Sequence
  Description of Artificial Sequence: Synthetic oligonucleotide
  Target: FXN; (+) strand; PAM type: YTN; PAM sequence: CTA
atttttgtatttttagtaga

SEQ ID NO: 33223 - DNA, 20 bp, Artificial Sequence
  Description of Artificial Sequence: Synthetic oligonucleotide
  Target: FXN; (+) strand; PAM type: YTN; PAM sequence: TTT
ttgtatttttagtagagaca

SEQ ID NO: 33224 - DNA, 20 bp, Artificial Sequence
  Description of Artificial Sequence: Synthetic oligonucleotide
  Target: FXN; (+) strand; PAM type: YTN; PAM sequence: TTT
tgtatttttagtagagacag

SEQ ID NO: 33225 - DNA, 20 bp, Artificial Sequence
  Description of Artificial Sequence: Synthetic oligonucleotide
  Target: FXN; (+) strand; PAM type: YTN; PAM sequence: TTT
gtatttttagtagagacagg

SEQ ID NO: 33226 - DNA, 20 bp, Artificial Sequence
  Description of Artificial Sequence: Synthetic oligonucleotide
  Target: FXN; (+) strand; PAM type: YTN; PAM sequence: TTG
tatttttagtagagacaggg

SEQ ID NO: 33227 - DNA, 20 bp, Artificial Sequence
  Description of Artificial Sequence: Synthetic oligonucleotide
  Target: FXN; (+) strand; PAM type: YTN; PAM sequence: TTT
ttagtagagacagggttttg

SEQ ID NO: 33228 - DNA, 20 bp, Artificial Sequence
  Description of Artificial Sequence: Synthetic oligonucleotide
  Target: FXN; (+) strand; PAM type: YTN; PAM sequence: TTT
tagtagagacagggttttgc

SEQ ID NO: 33229 - DNA, 20 bp, Artificial Sequence
  Description of Artificial Sequence: Synthetic oligonucleotide
  Target: FXN; (+) strand; PAM type: YTN; PAM sequence: TTT
agtagagacagggttttgcc

SEQ ID NO: 33230 - DNA, 20 bp, Artificial Sequence
  Description of Artificial Sequence: Synthetic oligonucleotide
  Target: FXN; (+) strand; PAM type: YTN; PAM sequence: TTA
gtagagacagggttttgcca

SEQ ID NO: 33231 - DNA, 20 bp, Artificial Sequence
  Description of Artificial Sequence: Synthetic oligonucleotide
  Target: FXN; (+) strand; PAM type: YTN; PAM sequence: TTT
tgccatattggcctggctag

SEQ ID NO: 33232 - DNA, 20 bp, Artificial Sequence
  Description of Artificial Sequence: Synthetic oligonucleotide
  Target: FXN; (+) strand; PAM type: YTN; PAM sequence: TTT
gccatattggcctggctagt

SEQ ID NO: 33233 - DNA, 20 bp, Artificial Sequence
  Description of Artificial Sequence: Synthetic oligonucleotide
  Target: FXN; (+) strand; PAM type: YTN; PAM sequence: TTG
ccatattggcctggctagtt

SEQ ID NO: 33234 - DNA, 20 bp, Artificial Sequence
  Description of Artificial Sequence: Synthetic oligonucleotide
  Target: FXN; (+) strand; PAM type: YTN; PAM sequence: TTG
gcctggctagtttcaaactc

SEQ ID NO: 33235 - DNA, 20 bp, Artificial Sequence
  Description of Artificial Sequence: Synthetic oligonucleotide
  Target: FXN; (+) strand; PAM type: YTN; PAM sequence: CTG
gctagtttcaaactcctgac

SEQ ID NO: 33236 - DNA, 20 bp, Artificial Sequence
  Description of Artificial Sequence: Synthetic oligonucleotide
  Target: FXN; (+) strand; PAM type: YTN; PAM sequence: CTA
gtttcaaactcctgacctca

SEQ ID NO: 33237 - DNA, 20 bp, Artificial Sequence
  Description of Artificial Sequence: Synthetic oligonucleotide
  Target: FXN; (+) strand; PAM type: YTN; PAM sequence: TTT
caaactcctgacctcaggtg

SEQ ID NO: 33238 - DNA, 20 bp, Artificial Sequence
  Description of Artificial Sequence: Synthetic oligonucleotide
  Target: FXN; (+) strand; PAM type: YTN; PAM sequence: TTC
aaactcctgacctcaggtga

SEQ ID NO: 33239 - DNA, 20 bp, Artificial Sequence
  Description of Artificial Sequence: Synthetic oligonucleotide
  Target: FXN; (+) strand; PAM type: YTN; PAM sequence: CTC
ctgacctcaggtgagccacc

SEQ ID NO: 33240 - DNA, 20 bp, Artificial Sequence
  Description of Artificial Sequence: Synthetic oligonucleotide
  Target: FXN; (+) strand; PAM type: YTN; PAM sequence: CTG
acctcaggtgagccacctac

SEQ ID NO: 33241 - DNA, 20 bp, Artificial Sequence
  Description of Artificial Sequence: Synthetic oligonucleotide
  Target: FXN; (+) strand; PAM type: YTN; PAM sequence: CTC
aggtgagccacctacctcgg

SEQ ID NO: 33242 - DNA, 20 bp, Artificial Sequence
  Description of Artificial Sequence: Synthetic oligonucleotide
  Target: FXN; (+) strand; PAM type: YTN; PAM sequence: CTA
cctcggcctccgaaagtcct

SEQ ID NO: 33243 - DNA, 20 bp, Artificial Sequence
  Description of Artificial Sequence: Synthetic oligonucleotide
  Target: FXN; (+) strand; PAM type: YTN; PAM sequence: CTC
ggcctccgaaagtcctggga

SEQ ID NO: 33244 - DNA, 20 bp, Artificial Sequence
  Description of Artificial Sequence: Synthetic oligonucleotide
  Target: FXN; (+) strand; PAM type: YTN; PAM sequence: CTC
cgaaagtcctgggattacag

SEQ ID NO: 33245 - DNA, 20 bp, Artificial Sequence
  Description of Artificial Sequence: Synthetic oligonucleotide
  Target: FXN; (+) strand; PAM type: YTN; PAM sequence: CTG
ggattacagacgtgagccac

SEQ ID NO: 33246 - DNA, 20 bp, Artificial Sequence
  Description of Artificial Sequence: Synthetic oligonucleotide
  Target: FXN; (+) strand; PAM type: YTN; PAM sequence: TTA
cagacgtgagccactgcact

SEQ ID NO: 33247 - DNA, 20 bp, Artificial Sequence
  Description of Artificial Sequence: Synthetic oligonucleotide
  Target: FXN; (+) strand; PAM type: YTN; PAM sequence: CTG
cactgcctggcccagaaagg

SEQ ID NO: 33248 - DNA, 20 bp, Artificial Sequence
  Description of Artificial Sequence: Synthetic oligonucleotide
  Target: FXN; (+) strand; PAM type: YTN; PAM sequence: CTG
cctggcccagaaaggactat

SEQ ID NO: 33249 - DNA, 20 bp, Artificial Sequence
  Description of Artificial Sequence: Synthetic oligonucleotide
  Target: FXN; (+) strand; PAM type: YTN; PAM sequence: CTG
gcccagaaaggactattaat

SEQ ID NO: 33250 - DNA, 20 bp, Artificial Sequence
  Description of Artificial Sequence: Synthetic oligonucleotide
  Target: FXN; (+) strand; PAM type: YTN; PAM sequence: CTA
ttaattgtagttgcctctgg

SEQ ID NO: 33251 - DNA, 20 bp, Artificial Sequence
  Description of Artificial Sequence: Synthetic oligonucleotide
  Target: FXN; (+) strand; PAM type: YTN; PAM sequence: TTA
attgtagttgcctctgggaa

SEQ ID NO: 33252 - DNA, 20 bp, Artificial Sequence
  Description of Artificial Sequence: Synthetic oligonucleotide
  Target: FXN; (+) strand; PAM type: YTN; PAM sequence: TTG
tagttgcctctgggaatggg

SEQ ID NO: 33253 - DNA, 20 bp, Artificial Sequence
  Description of Artificial Sequence: Synthetic oligonucleotide
  Target: FXN; (+) strand; PAM type: YTN; PAM sequence: TTG
cctctgggaatgggggctgc

SEQ ID NO: 33254 - DNA, 20 bp, Artificial Sequence
  Description of Artificial Sequence: Synthetic oligonucleotide
  Target: FXN; (+) strand; PAM type: YTN; PAM sequence: CTC
tgggaatgggggctgcctgc

SEQ ID NO: 33255 - DNA, 20 bp, Artificial Sequence
  Description of Artificial Sequence: Synthetic oligonucleotide
  Target: FXN; (+) strand; PAM type: YTN; PAM sequence: CTG
ggaatgggggctgcctgctt

SEQ ID NO: 33256 - DNA, 20 bp, Artificial Sequence
  Description of Artificial Sequence: Synthetic oligonucleotide
  Target: FXN; (+) strand; PAM type: YTN; PAM sequence: CTG
cctgcttctttctgtaaccc

SEQ ID NO: 33257 - DNA, 20 bp, Artificial Sequence
  Description of Artificial Sequence: Synthetic oligonucleotide
  Target: FXN; (+) strand; PAM type: YTN; PAM sequence: CTG
cttctttctgtaaccccttc

SEQ ID NO: 33258 - DNA, 20 bp, Artificial Sequence
  Description of Artificial Sequence: Synthetic oligonucleotide
  Target: FXN; (+) strand; PAM type: YTN; PAM sequence: CTT
ctttctgtaaccccttctgt

SEQ ID NO: 33259 - DNA, 20 bp, Artificial Sequence
  Description of Artificial Sequence: Synthetic oligonucleotide
  Target: FXN; (+) strand; PAM type: YTN; PAM sequence: TTC
tttctgtaaccccttctgtg

SEQ ID NO: 33260 - DNA, 20 bp, Artificial Sequence
  Description of Artificial Sequence: Synthetic oligonucleotide
  Target: FXN; (+) strand; PAM type: YTN; PAM sequence: CTT
tctgtaaccccttctgtgct

SEQ ID NO: 33261 - DNA, 20 bp, Artificial Sequence
  Description of Artificial Sequence: Synthetic oligonucleotide
  Target: FXN; (+) strand; PAM type: YTN; PAM sequence: TTT
ctgtaaccccttctgtgctg

SEQ ID NO: 33262 - DNA, 20 bp, Artificial Sequence
  Description of Artificial Sequence: Synthetic oligonucleotide
  Target: FXN; (+) strand; PAM type: YTN; PAM sequence: TTC
tgtaaccccttctgtgctgt

SEQ ID NO: 33263 - DNA, 20 bp, Artificial Sequence
  Description of Artificial Sequence: Synthetic oligonucleotide
  Target: FXN; (+) strand; PAM type: YTN; PAM sequence: CTG
taaccccttctgtgctgttt

SEQ ID NO: 33264 - DNA, 20 bp, Artificial Sequence
  Description of Artificial Sequence: Synthetic oligonucleotide
  Target: FXN; (+) strand; PAM type: YTN; PAM sequence: CTT
ctgtgctgtttaaatttttt

SEQ ID NO: 33265 - DNA, 20 bp, Artificial Sequence
  Description of Artificial Sequence: Synthetic oligonucleotide
  Target: FXN; (+) strand; PAM type: YTN; PAM sequence: TTC
tgtgctgtttaaattttttt

SEQ ID NO: 33266 - DNA, 20 bp, Artificial Sequence
  Description of Artificial Sequence: Synthetic oligonucleotide
  Target: FXN; (+) strand; PAM type: YTN; PAM sequence: CTG
tgctgtttaaattttttttt

SEQ ID NO: 33267 - DNA, 20 bp, Artificial Sequence
  Description of Artificial Sequence: Synthetic oligonucleotide
  Target: FXN; (+) strand; PAM type: YTN; PAM sequence: CTG
tttaaatttttttttttttt

SEQ ID NO: 33268 - DNA, 20 bp, Artificial Sequence
  Description of Artificial Sequence: Synthetic oligonucleotide
  Target: FXN; (+) strand; PAM type: YTN; PAM sequence: TTT
aaattttttttttttttttt

SEQ ID NO: 33269 - DNA, 20 bp, Artificial Sequence
  Description of Artificial Sequence: Synthetic oligonucleotide
  Target: FXN; (+) strand; PAM type: YTN; PAM sequence: TTA
aatttttttttttttttttt

SEQ ID NO: 33270 - DNA, 20 bp, Artificial Sequence
  Description of Artificial Sequence: Synthetic oligonucleotide
  Target: FXN; (+) strand; PAM type: YTN; PAM sequence: TTT
tttttttttttttttttttt

SEQ ID NO: 33271 - DNA, 20 bp, Artificial Sequence
  Description of Artificial Sequence: Synthetic oligonucleotide
  Target: FXN; (+) strand; PAM type: YTN; PAM sequence: TTT
tttttttttttttttttttg

SEQ ID NO: 33272 - DNA, 20 bp, Artificial Sequence
  Description of Artificial Sequence: Synthetic oligonucleotide
  Target: FXN; (+) strand; PAM type: YTN; PAM sequence: TTT
ttttttttttttttttttga

SEQ ID NO: 33273 - DNA, 20 bp, Artificial Sequence
  Description of Artificial Sequence: Synthetic oligonucleotide
  Target: FXN; (+) strand; PAM type: YTN; PAM sequence: TTT
tttttttttttttttttgag

SEQ ID NO: 33274 - DNA, 20 bp, Artificial Sequence
  Description of Artificial Sequence: Synthetic oligonucleotide
  Target: FXN; (+) strand; PAM type: YTN; PAM sequence: TTT
ttttttttttttttttgaga

SEQ ID NO: 33275 - DNA, 20 bp, Artificial Sequence
  Description of Artificial Sequence: Synthetic oligonucleotide
  Target: FXN; (+) strand; PAM type: YTN; PAM sequence: TTT
tttttttttttttttgagac

SEQ ID NO: 33276 - DNA, 20 bp, Artificial Sequence
  Description of Artificial Sequence: Synthetic oligonucleotide
  Target: FXN; (+) strand; PAM type: YTN; PAM sequence: TTT
ttttttttttttttgagaca

SEQ ID NO: 33277 - DNA, 20 bp, Artificial Sequence
  Description of Artificial Sequence: Synthetic oligonucleotide
  Target: FXN; (+) strand; PAM type: YTN; PAM sequence: TTT
tttttttttttttgagacag

SEQ ID NO: 33278 - DNA, 20 bp, Artificial Sequence
  Description of Artificial Sequence: Synthetic oligonucleotide
  Target: FXN; (+) strand; PAM type: YTN; PAM sequence: TTT
ttttttttttttgagacaga

SEQ ID NO: 33279 - DNA, 20 bp, Artificial Sequence
  Description of Artificial Sequence: Synthetic oligonucleotide
  Target: FXN; (+) strand; PAM type: YTN; PAM sequence: TTT
tttttttttttgagacagag

SEQ ID NO: 33280 - DNA, 20 bp, Artificial Sequence
  Description of Artificial Sequence: Synthetic oligonucleotide
  Target: FXN; (+) strand; PAM type: YTN; PAM sequence: TTT
ttttttttttgagacagagt

SEQ ID NO: 33281 - DNA, 20 bp, Artificial Sequence
  Description of Artificial Sequence: Synthetic oligonucleotide
  Target: FXN; (+) strand; PAM type: YTN; PAM sequence: TTT
tttttttttgagacagagtc

SEQ ID NO: 33282 - DNA, 20 bp, Artificial Sequence
  Description of Artificial Sequence: Synthetic oligonucleotide
  Target: FXN; (+) strand; PAM type: YTN; PAM sequence: TTT
ttttttttgagacagagtct

SEQ ID NO: 33283 - DNA, 20 bp, Artificial Sequence
  Description of Artificial Sequence: Synthetic oligonucleotide
  Target: FXN; (+) strand; PAM type: YTN; PAM sequence: TTT
tttttttgagacagagtctc

SEQ ID NO: 33284 - DNA, 20 bp, Artificial Sequence
  Description of Artificial Sequence: Synthetic oligonucleotide
  Target: FXN; (+) strand; PAM type: YTN; PAM sequence: TTT
ttttttgagacagagtctcg

SEQ ID NO: 33285 - DNA, 20 bp, Artificial Sequence
  Description of Artificial Sequence: Synthetic oligonucleotide
  Target: FXN; (+) strand; PAM type: YTN; PAM sequence: TTT
tttttgagacagagtctcgc

SEQ ID NO: 33286 - DNA, 20 bp, Artificial Sequence
  Description of Artificial Sequence: Synthetic oligonucleotide
  Target: FXN; (+) strand; PAM type: YTN; PAM sequence: TTT
ttttgagacagagtctcgct

SEQ ID NO: 33287 - DNA, 20 bp, Artificial Sequence
  Description of Artificial Sequence: Synthetic oligonucleotide
  Target: FXN; (+) strand; PAM type: YTN; PAM sequence: TTT
tttgagacagagtctcgctc

SEQ ID NO: 33288 - DNA, 20 bp, Artificial Sequence
  Description of Artificial Sequence: Synthetic oligonucleotide
  Target: FXN; (+) strand; PAM type: YTN; PAM sequence: TTT
ttgagacagagtctcgctct

SEQ ID NO: 33289 - DNA, 20 bp, Artificial Sequence
  Description of Artificial Sequence: Synthetic oligonucleotide
  Target: FXN; (+) strand; PAM type: YTN; PAM sequence: TTT
tgagacagagtctcgctctg

SEQ ID NO: 33290 - DNA, 20 bp, Artificial Sequence
  Description of Artificial Sequence: Synthetic oligonucleotide
  Target: FXN; (+) strand; PAM type: YTN; PAM sequence: TTT
gagacagagtctcgctctgt

SEQ ID NO: 33291 - DNA, 20 bp, Artificial Sequence
  Description of Artificial Sequence: Synthetic oligonucleotide
  Target: FXN; (+) strand; PAM type: YTN; PAM sequence: TTG
agacagagtctcgctctgtc

SEQ ID NO: 33292 - DNA, 20 bp, Artificial Sequence
  Description of Artificial Sequence: Synthetic oligonucleotide
  Target: FXN; (+) strand; PAM type: YTN; PAM sequence: CTC
gctctgtcgcccaggctgga

SEQ ID NO: 33293 - DNA, 20 bp, Artificial Sequence
  Description of Artificial Sequence: Synthetic oligonucleotide
  Target: FXN; (+) strand; PAM type: YTN; PAM sequence: CTC
tgtcgcccaggctggagtgc

SEQ ID NO: 33294 - DNA, 20 bp, Artificial Sequence
  Description of Artificial Sequence: Synthetic oligonucleotide
  Target: FXN; (+) strand; PAM type: YTN; PAM sequence: CTG
tcgcccaggctggagtgcag

SEQ ID NO: 33295 - DNA, 20 bp, Artificial Sequence
  Description of Artificial Sequence: Synthetic oligonucleotide
  Target: FXN; (+) strand; PAM type: YTN; PAM sequence: CTG
gagtgcagtggcgcaatctc

SEQ ID NO: 33296 - DNA, 20 bp, Artificial Sequence
  Description of Artificial Sequence: Synthetic oligonucleotide
  Target: FXN; (+) strand; PAM type: YTN; PAM sequence: CTC
ggctcactgcaagctccgcc

SEQ ID NO: 33297 - DNA, 20 bp, Artificial Sequence
  Description of Artificial Sequence: Synthetic oligonucleotide
  Target: FXN; (+) strand; PAM type: YTN; PAM sequence: CTC
actgcaagctccgcctccca

SEQ ID NO: 33298 - DNA, 20 bp, Artificial Sequence
  Description of Artificial Sequence: Synthetic oligonucleotide
  Target: FXN; (+) strand; PAM type: YTN; PAM sequence: CTG
caagctccgcctcccaggtt

SEQ ID NO: 33299 - DNA, 20 bp, Artificial Sequence
  Description of Artificial Sequence: Synthetic oligonucleotide
  Target: FXN; (+) strand; PAM type: YTN; PAM sequence: CTC
cgcctcccaggttcacgcca

SEQ ID NO: 33300 - DNA, 20 bp, Artificial Sequence
  Description of Artificial Sequence: Synthetic oligonucleotide
  Target: FXN; (+) strand; PAM type: YTN; PAM sequence: CTC
ccaggttcacgccattctcc

SEQ ID NO: 33301 - DNA, 20 bp, Artificial Sequence
  Description of Artificial Sequence: Synthetic oligonucleotide
  Target: FXN; (+) strand; PAM type: YTN; PAM sequence: TTC
acgccattctcctgcctcag

SEQ ID NO: 33302 - DNA, 20 bp, Artificial Sequence
  Description of Artificial Sequence: Synthetic oligonucleotide
  Target: FXN; (+) strand; PAM type: YTN; PAM sequence: TTC
tcctgcctcagcctcctgag

SEQ ID NO: 33303 - DNA, 20 bp, Artificial Sequence
  Description of Artificial Sequence: Synthetic oligonucleotide
  Target: FXN; (+) strand; PAM type: YTN; PAM sequence: CTC
ctgcctcagcctcctgagta

SEQ ID NO: 33304 - DNA, 20 bp, Artificial Sequence
  Description of Artificial Sequence: Synthetic oligonucleotide
  Target: FXN; (+) strand; PAM type: YTN; PAM sequence: CTG
cctcagcctcctgagtagct

SEQ ID NO: 33305 - DNA, 20 bp, Artificial Sequence
  Description of Artificial Sequence: Synthetic oligonucleotide
  Target: FXN; (+) strand; PAM type: YTN; PAM sequence: CTC
agcctcctgagtagctggga

SEQ ID NO: 33306 - DNA, 20 bp, Artificial Sequence
  Description of Artificial Sequence: Synthetic oligonucleotide
  Target: FXN; (+) strand; PAM type: YTN; PAM sequence: CTC
ctgagtagctgggactacag

SEQ ID NO: 33307 - DNA, 20 bp, Artificial Sequence
  Description of Artificial Sequence: Synthetic oligonucleotide
  Target: FXN; (+) strand; PAM type: YTN; PAM sequence: CTG
agtagctgggactacaggca

SEQ ID NO: 33308 - DNA, 20 bp, Artificial Sequence
  Description of Artificial Sequence: Synthetic oligonucleotide
  Target: FXN; (+) strand; PAM type: YTN; PAM sequence: CTG
ggactacaggcacccgtcac

SEQ ID NO: 33309 - DNA, 20 bp, Artificial Sequence
  Description of Artificial Sequence: Synthetic oligonucleotide
  Target: FXN; (+) strand; PAM type: YTN; PAM sequence: CTA
caggcacccgtcaccacgcc

SEQ ID NO: 33310 - DNA, 20 bp, Artificial Sequence
  Description of Artificial Sequence: Synthetic oligonucleotide
  Target: FXN; (+) strand; PAM type: YTN; PAM sequence: CTA
attttttgtattttcagtag

SEQ ID NO: 33311 - DNA, 20 bp, Artificial Sequence
  Description of Artificial Sequence: Synthetic oligonucleotide
  Target: FXN; (+) strand; PAM type: YTN; PAM sequence: TTT
tttgtattttcagtagagac

SEQ ID NO: 33312 - DNA, 20 bp, Artificial Sequence
  Description of Artificial Sequence: Synthetic oligonucleotide
  Target: FXN; (+) strand; PAM type: YTN; PAM sequence: TTT
ttgtattttcagtagagacg

SEQ ID NO: 33313 - DNA, 20 bp, Artificial Sequence
  Description of Artificial Sequence: Synthetic oligonucleotide
  Target: FXN; (+) strand; PAM type: YTN; PAM sequence: TTT
tgtattttcagtagagacgg

SEQ ID NO: 33314 - DNA, 20 bp, Artificial Sequence
  Description of Artificial Sequence: Synthetic oligonucleotide
  Target: FXN; (+) strand; PAM type: YTN; PAM sequence: TTT
gtattttcagtagagacggg

SEQ ID NO: 33315 - DNA, 20 bp, Artificial Sequence
  Description of Artificial Sequence: Synthetic oligonucleotide
  Target: FXN; (+) strand; PAM type: YTN; PAM sequence: TTG
tattttcagtagagacgggg

SEQ ID NO: 33316 - DNA, 20 bp, Artificial Sequence
  Description of Artificial Sequence: Synthetic oligonucleotide
  Target: FXN; (+) strand; PAM type: YTN; PAM sequence: TTT
tcagtagagacggggtttca

SEQ ID NO: 33317 - DNA, 20 bp, Artificial Sequence
  Description of Artificial Sequence: Synthetic oligonucleotide
  Target: FXN; (+) strand; PAM type: YTN; PAM sequence: TTT
cagtagagacggggtttcac

SEQ ID NO: 33318 - DNA, 20 bp, Artificial Sequence
  Description of Artificial Sequence: Synthetic oligonucleotide
  Target: FXN; (+) strand; PAM type: YTN; PAM sequence: TTC
agtagagacggggtttcacc

SEQ ID NO: 33319 - DNA, 20 bp, Artificial Sequence
  Description of Artificial Sequence: Synthetic oligonucleotide
  Target: FXN; (+) strand; PAM type: YTN; PAM sequence: TTT
caccatgttagccaggatgg

SEQ ID NO: 33320 - DNA, 20 bp, Artificial Sequence
  Description of Artificial Sequence: Synthetic oligonucleotide
  Target: FXN; (+) strand; PAM type: YTN; PAM sequence: TTC
accatgttagccaggatggt

SEQ ID NO: 33321 - DNA, 20 bp, Artificial Sequence
  Description of Artificial Sequence: Synthetic oligonucleotide
  Target: FXN; (+) strand; PAM type: YTN; PAM sequence: TTA
gccaggatggtctcgatctc

SEQ ID NO: 33322 - DNA, 20 bp, Artificial Sequence
  Description of Artificial Sequence: Synthetic oligonucleotide
  Target: FXN; (+) strand; PAM type: YTN; PAM sequence: CTC
gatctcctgaccgtgttatc

SEQ ID NO: 33323 - DNA, 20 bp, Artificial Sequence
  Description of Artificial Sequence: Synthetic oligonucleotide
  Target: FXN; (+) strand; PAM type: YTN; PAM sequence: CTC
ctgaccgtgttatctgcctg

SEQ ID NO: 33324 - DNA, 20 bp, Artificial Sequence
  Description of Artificial Sequence: Synthetic oligonucleotide
  Target: FXN; (+) strand; PAM type: YTN; PAM sequence: CTG
accgtgttatctgcctgcct

SEQ ID NO: 33325 - DNA, 20 bp, Artificial Sequence
  Description of Artificial Sequence: Synthetic oligonucleotide
  Target: FXN; (+) strand; PAM type: YTN; PAM sequence: TTA
tctgcctgcctcggcctccc

SEQ ID NO: 33326 - DNA, 20 bp, Artificial Sequence
  Description of Artificial Sequence: Synthetic oligonucleotide
  Target: FXN; (+) strand; PAM type: YTN; PAM sequence: CTG
cctgcctcggcctcccagag

SEQ ID NO: 33327 - DNA, 20 bp, Artificial Sequence
  Description of Artificial Sequence: Synthetic oligonucleotide
  Target: FXN; (+) strand; PAM type: YTN; PAM sequence: CTG
cctcggcctcccagagtgct

SEQ ID NO: 33328 - DNA, 20 bp, Artificial Sequence
  Description of Artificial Sequence: Synthetic oligonucleotide
  Target: FXN; (+) strand; PAM type: YTN; PAM sequence: CTC
ggcctcccagagtgctggga

SEQ ID NO: 33329 - DNA, 20 bp, Artificial Sequence
  Description of Artificial Sequence: Synthetic oligonucleotide
  Target: FXN; (+) strand; PAM type: YTN; PAM sequence: CTC
ccagagtgctgggattacag

SEQ ID NO: 33330 - DNA, 20 bp, Artificial Sequence
  Description of Artificial Sequence: Synthetic oligonucleotide
  Target: FXN; (+) strand; PAM type: YTN; PAM sequence: CTG
ggattacaggcatgagctac

SEQ ID NO: 33331 - DNA, 20 bp, Artificial Sequence
  Description of Artificial Sequence: Synthetic oligonucleotide
  Target: FXN; (+) strand; PAM type: YTN; PAM sequence: TTA
caggcatgagctaccacgcc

SEQ ID NO: 33332 - DNA, 20 bp, Artificial Sequence
  Description of Artificial Sequence: Synthetic oligonucleotide
  Target: FXN; (+) strand; PAM type: YTN; PAM sequence: CTA
ccacgcccggcctttaaatt

SEQ ID NO: 33333 - DNA, 20 bp, Artificial Sequence
  Description of Artificial Sequence: Synthetic oligonucleotide
  Target: FXN; (+) strand; PAM type: YTN; PAM sequence: CTT
taaatttttactttgggccg

SEQ ID NO: 33334 - DNA, 20 bp, Artificial Sequence
  Description of Artificial Sequence: Synthetic oligonucleotide
  Target: FXN; (+) strand; PAM type: YTN; PAM sequence: TTT
aaatttttactttgggccgg

SEQ ID NO: 33335 - DNA, 20 bp, Artificial Sequence
  Description of Artificial Sequence: Synthetic oligonucleotide
  Target: FXN; (+) strand; PAM type: YTN; PAM sequence: TTA
aatttttactttgggccggg

SEQ ID NO: 33336 - DNA, 20 bp, Artificial Sequence
  Description of Artificial Sequence: Synthetic oligonucleotide
  Target: FXN; (+) strand; PAM type: YTN; PAM sequence: TTT
ttactttgggccgggcacgg

SEQ ID NO: 33337 - DNA, 20 bp, Artificial Sequence
  Description of Artificial Sequence: Synthetic oligonucleotide
  Target: FXN; (+) strand; PAM type: YTN; PAM sequence: TTT
tactttgggccgggcacggt

SEQ ID NO: 33338 - DNA, 20 bp, Artificial Sequence
  Description of Artificial Sequence: Synthetic oligonucleotide
  Target: FXN; (+) strand; PAM type: YTN; PAM sequence: TTT
actttgggccgggcacggtg

SEQ ID NO: 33339 - DNA, 20 bp, Artificial Sequence
  Description of Artificial Sequence: Synthetic oligonucleotide
  Target: FXN; (+) strand; PAM type: YTN; PAM sequence: TTA
ctttgggccgggcacggtgc

SEQ ID NO: 33340 - DNA, 20 bp, Artificial Sequence
  Description of Artificial Sequence: Synthetic oligonucleotide
  Target: FXN; (+) strand; PAM type: YTN; PAM sequence: CTT
tgggccgggcacggtgcctt

SEQ ID NO: 33341 - DNA, 20 bp, Artificial Sequence
  Description of Artificial Sequence: Synthetic oligonucleotide
  Target: FXN; (+) strand; PAM type: YTN; PAM sequence: TTT
gggccgggcacggtgcctta

SEQ ID NO: 33342 - DNA, 20 bp, Artificial Sequence
  Description of Artificial Sequence: Synthetic oligonucleotide
  Target: FXN; (+) strand; PAM type: YTN; PAM sequence: TTG
ggccgggcacggtgccttac

SEQ ID NO: 33343 - DNA, 20 bp, Artificial Sequence
  Description of Artificial Sequence: Synthetic oligonucleotide
  Target: FXN; (+) strand; PAM type: YTN; PAM sequence: CTT
acgcctgtaatcctaacatt

SEQ ID NO: 33344 - DNA, 20 bp, Artificial Sequence
  Description of Artificial Sequence: Synthetic oligonucleotide
  Target: FXN; (+) strand; PAM type: YTN; PAM sequence: TTA
cgcctgtaatcctaacattt

SEQ ID NO: 33345 - DNA, 20 bp, Artificial Sequence
  Description of Artificial Sequence: Synthetic oligonucleotide
  Target: FXN; (+) strand; PAM type: YTN; PAM sequence: CTG
taatcctaacatttcgagaa

SEQ ID NO: 33346 - DNA, 20 bp, Artificial Sequence
  Description of Artificial Sequence: Synthetic oligonucleotide
  Target: FXN; (+) strand; PAM type: YTN; PAM sequence: CTA
acatttcgagaagctgaggc

SEQ ID NO: 33347 - DNA, 20 bp, Artificial Sequence
  Description of Artificial Sequence: Synthetic oligonucleotide
  Target: FXN; (+) strand; PAM type: YTN; PAM sequence: TTT
cgagaagctgaggcacgtgg

SEQ ID NO: 33348 - DNA, 20 bp, Artificial Sequence
  Description of Artificial Sequence: Synthetic oligonucleotide
  Target: FXN; (+) strand; PAM type: YTN; PAM sequence: TTC
gagaagctgaggcacgtggt

SEQ ID NO: 33349 - DNA, 20 bp, Artificial Sequence
  Description of Artificial Sequence: Synthetic oligonucleotide
  Target: FXN; (+) strand; PAM type: YTN; PAM sequence: CTG
aggcacgtggtggatcactt

SEQ ID NO: 33350 - DNA, 20 bp, Artificial Sequence
  Description of Artificial Sequence: Synthetic oligonucleotide
  Target: FXN; (+) strand; PAM type: YTN; PAM sequence: CTT
gatgtcacgagttcagacca

SEQ ID NO: 33351 - DNA, 20 bp, Artificial Sequence
  Description of Artificial Sequence: Synthetic oligonucleotide
  Target: FXN; (+) strand; PAM type: YTN; PAM sequence: TTG
atgtcacgagttcagaccag

SEQ ID NO: 33352 - DNA, 20 bp, Artificial Sequence
  Description of Artificial Sequence: Synthetic oligonucleotide
  Target: FXN; (+) strand; PAM type: YTN; PAM sequence: TTC
agaccagccactgcactcca

SEQ ID NO: 33353 - DNA, 20 bp, Artificial Sequence
  Description of Artificial Sequence: Synthetic oligonucleotide
  Target: FXN; (+) strand; PAM type: YTN; PAM sequence: CTG
cactccagcctgggtgacag

SEQ ID NO: 33354 - DNA, 20 bp, Artificial Sequence
  Description of Artificial Sequence: Synthetic oligonucleotide
  Target: FXN; (+) strand; PAM type: YTN; PAM sequence: CTC
cagcctgggtgacagagtga

SEQ ID NO: 33355 - DNA, 20 bp, Artificial Sequence
  Description of Artificial Sequence: Synthetic oligonucleotide
  Target: FXN; (+) strand; PAM type: YTN; PAM sequence: CTG
ggtgacagagtgagactctg

SEQ ID NO: 33356 - DNA, 20 bp, Artificial Sequence
  Description of Artificial Sequence: Synthetic oligonucleotide
  Target: FXN; (+) strand; PAM type: YTN; PAM sequence: CTC
tgtctcaaaaaaaaaaaaaa

SEQ ID NO: 33357 - DNA, 20 bp, Artificial Sequence
  Description of Artificial Sequence: Synthetic oligonucleotide
  Target: FXN; (+) strand; PAM type: YTN; PAM sequence: CTG
tctcaaaaaaaaaaaaaaaa

SEQ ID NO: 33358 - DNA, 20 bp, Artificial Sequence
  Description of Artificial Sequence: Synthetic oligonucleotide
  Target: FXN; (+) strand; PAM type: YTN; PAM sequence: CTC
aaaaaaaaaaaaaaaagaaa

SEQ ID NO: 33359 - DNA, 20 bp, Artificial Sequence
  Description of Artificial Sequence: Synthetic oligonucleotide
  Target: FXN; (+) strand; PAM type: YTN; PAM sequence: CTT
ttactttttacatgttattt

SEQ ID NO: 33360 - DNA, 20 bp, Artificial Sequence
  Description of Artificial Sequence: Synthetic oligonucleotide
  Target: FXN; (+) strand; PAM type: YTN; PAM sequence: TTT
tactttttacatgttatttt

SEQ ID NO: 33361 - DNA, 20 bp, Artificial Sequence
  Description of Artificial Sequence: Synthetic oligonucleotide
  Target: FXN; (+) strand; PAM type: YTN; PAM sequence: TTT
actttttacatgttattttc

SEQ ID NO: 33362 - DNA, 20 bp, Artificial Sequence
  Description of Artificial Sequence: Synthetic oligonucleotide
  Target: FXN; (+) strand; PAM type: YTN; PAM sequence: TTA
ctttttacatgttattttca

SEQ ID NO: 33363 - DNA, 20 bp, Artificial Sequence
  Description of Artificial Sequence: Synthetic oligonucleotide
  Target: FXN; (+) strand; PAM type: YTN; PAM sequence: CTT
tttacatgttattttcatca

SEQ ID NO: 33364 - DNA, 20 bp, Artificial Sequence
  Description of Artificial Sequence: Synthetic oligonucleotide
  Target: FXN; (+) strand; PAM type: YTN; PAM sequence: TTT
ttacatgttattttcatcaa

SEQ ID NO: 33365 - DNA, 20 bp, Artificial Sequence
  Description of Artificial Sequence: Synthetic oligonucleotide
  Target: FXN; (+) strand; PAM type: YTN; PAM sequence: TTT
tacatgttattttcatcaat

SEQ ID NO: 33366 - DNA, 20 bp, Artificial Sequence
  Description of Artificial Sequence: Synthetic oligonucleotide
  Target: FXN; (+) strand; PAM type: YTN; PAM sequence: TTT
acatgttattttcatcaatt

SEQ ID NO: 33367 - DNA, 20 bp, Artificial Sequence
  Description of Artificial Sequence: Synthetic oligonucleotide
  Target: FXN; (+) strand; PAM type: YTN; PAM sequence: TTA
catgttattttcatcaattt

SEQ ID NO: 33368 - DNA, 20 bp, Artificial Sequence
  Description of Artificial Sequence: Synthetic oligonucleotide
  Target: FXN; (+) strand; PAM type: YTN; PAM sequence: TTA
ttttcatcaatttaatgaat

SEQ ID NO: 33369 - DNA, 20 bp, Artificial Sequence
  Description of Artificial Sequence: Synthetic oligonucleotide
  Target: FXN; (+) strand; PAM type: YTN; PAM sequence: TTT
tcatcaatttaatgaattta

SEQ ID NO: 33370 - DNA, 20 bp, Artificial Sequence
  Description of Artificial Sequence: Synthetic oligonucleotide
  Target: FXN; (+) strand; PAM type: YTN; PAM sequence: TTT
catcaatttaatgaatttaa

SEQ ID NO: 33371 - DNA, 20 bp, Artificial Sequence
  Description of Artificial Sequence: Synthetic oligonucleotide
  Target: FXN; (+) strand; PAM type: YTN; PAM sequence: TTC
atcaatttaatgaatttaaa

SEQ ID NO: 33372 - DNA, 20 bp, Artificial Sequence
  Description of Artificial Sequence: Synthetic oligonucleotide
  Target: FXN; (+) strand; PAM type: YTN; PAM sequence: TTT
aatgaatttaaataacaaat

SEQ ID NO: 33373 - DNA, 20 bp, Artificial Sequence
  Description of Artificial Sequence: Synthetic oligonucleotide
  Target: FXN; (+) strand; PAM type: YTN; PAM sequence: TTA
atgaatttaaataacaaatg

SEQ ID NO: 33374 - DNA, 20 bp, Artificial Sequence
  Description of Artificial Sequence: Synthetic oligonucleotide
  Target: FXN; (+) strand; PAM type: YTN; PAM sequence: TTT
aaataacaaatgtataaatt

SEQ ID NO: 33375 - DNA, 20 bp, Artificial Sequence
  Description of Artificial Sequence: Synthetic oligonucleotide
  Target: FXN; (+) strand; PAM type: YTN; PAM sequence: TTA
aataacaaatgtataaattt

SEQ ID NO: 33376 - DNA, 20 bp, Artificial Sequence
  Description of Artificial Sequence: Synthetic oligonucleotide
  Target: FXN; (+) strand; PAM type: YTN; PAM sequence: TTT
gatattaataaaatggaagc

SEQ ID NO: 33377 - DNA, 20 bp, Artificial Sequence
  Description of Artificial Sequence: Synthetic oligonucleotide
  Target: FXN; (+) strand; PAM type: YTN; PAM sequence: TTG
atattaataaaatggaagca

SEQ ID NO: 33378 - DNA, 20 bp, Artificial Sequence
  Description of Artificial Sequence: Synthetic oligonucleotide
  Target: FXN; (+) strand; PAM type: YTN; PAM sequence: TTA
ataaaatggaagcatttggt

SEQ ID NO: 33379 - DNA, 20 bp, Artificial Sequence
  Description of Artificial Sequence: Synthetic oligonucleotide
  Target: FXN; (+) strand; PAM type: YTN; PAM sequence: TTT
ggtaatcatgttttgggttt

SEQ ID NO: 33380 - DNA, 20 bp, Artificial Sequence
  Description of Artificial Sequence: Synthetic oligonucleotide
  Target: FXN; (+) strand; PAM type: YTN; PAM sequence: TTG
gtaatcatgttttgggtttt

SEQ ID NO: 33381 - DNA, 20 bp, Artificial Sequence
  Description of Artificial Sequence: Synthetic oligonucleotide
  Target: FXN; (+) strand; PAM type: YTN; PAM sequence: TTT
tgggttttgtgcttcctctg

SEQ ID NO: 33382 - DNA, 20 bp, Artificial Sequence
  Description of Artificial Sequence: Synthetic oligonucleotide
  Target: FXN; (+) strand; PAM type: YTN; PAM sequence: TTT
gggttttgtgcttcctctgc

SEQ ID NO: 33383 - DNA, 20 bp, Artificial Sequence
  Description of Artificial Sequence: Synthetic oligonucleotide
  Target: FXN; (+) strand; PAM type: YTN; PAM sequence: TTG
ggttttgtgcttcctctgca

SEQ ID NO: 33384 - DNA, 20 bp, Artificial Sequence
  Description of Artificial Sequence: Synthetic oligonucleotide
  Target: FXN; (+) strand; PAM type: YTN; PAM sequence: TTT
tgtgcttcctctgcagctct

SEQ ID NO: 33385 - DNA, 20 bp, Artificial Sequence
  Description of Artificial Sequence: Synthetic oligonucleotide
  Target: FXN; (+) strand; PAM type: YTN; PAM sequence: TTT
gtgcttcctctgcagctctc

SEQ ID NO: 33386 - DNA, 20 bp, Artificial Sequence
  Description of Artificial Sequence: Synthetic oligonucleotide
  Target: FXN; (+) strand; PAM type: YTN; PAM sequence: TTG
tgcttcctctgcagctctct

SEQ ID NO: 33387 - DNA, 20 bp, Artificial Sequence
  Description of Artificial Sequence: Synthetic oligonucleotide
  Target: FXN; (+) strand; PAM type: YTN; PAM sequence: CTT
cctctgcagctctctagatg

SEQ ID NO: 33388 - DNA, 20 bp, Artificial Sequence
  Description of Artificial Sequence: Synthetic oligonucleotide
  Target: FXN; (+) strand; PAM type: YTN; PAM sequence: TTC
ctctgcagctctctagatga

SEQ ID NO: 33389 - DNA, 20 bp, Artificial Sequence
  Description of Artificial Sequence: Synthetic oligonucleotide
  Target: FXN; (+) strand; PAM type: YTN; PAM sequence: CTC
tgcagctctctagatgagac

SEQ ID NO: 33390 - DNA, 20 bp, Artificial Sequence
  Description of Artificial Sequence: Synthetic oligonucleotide
  Target: FXN; (+) strand; PAM type: YTN; PAM sequence: CTG
cagctctctagatgagacca

SEQ ID NO: 33391 - DNA, 20 bp, Artificial Sequence
  Description of Artificial Sequence: Synthetic oligonucleotide
  Target: FXN; (+) strand; PAM type: YTN; PAM sequence: CTC
tctagatgagaccacctatg

SEQ ID NO: 33392 - DNA, 20 bp, Artificial Sequence
  Description of Artificial Sequence: Synthetic oligonucleotide
  Target: FXN; (+) strand; PAM type: YTN; PAM sequence: CTC
tagatgagaccacctatgaa

SEQ ID NO: 33393 - DNA, 20 bp, Artificial Sequence
  Description of Artificial Sequence: Synthetic oligonucleotide
  Target: FXN; (+) strand; PAM type: YTN; PAM sequence: CTA
gatgagaccacctatgaaag

SEQ ID NO: 33394 - DNA, 20 bp, Artificial Sequence
  Description of Artificial Sequence: Synthetic oligonucleotide
  Target: FXN; (+) strand; PAM type: YTN; PAM sequence: CTA
tgaaagactagcagaggaaa

SEQ ID NO: 33395 - DNA, 20 bp, Artificial Sequence
  Description of Artificial Sequence: Synthetic oligonucleotide
  Target: FXN; (+) strand; PAM type: YTN; PAM sequence: CTA
gcagaggaaacgctggactc

SEQ ID NO: 33396 - DNA, 20 bp, Artificial Sequence
  Description of Artificial Sequence: Synthetic oligonucleotide
  Target: FXN; (+) strand; PAM type: YTN; PAM sequence: CTG
gactctttagcagagttttt

SEQ ID NO: 33397 - DNA, 20 bp, Artificial Sequence
  Description of Artificial Sequence: Synthetic oligonucleotide
  Target: FXN; (+) strand; PAM type: YTN; PAM sequence: CTC
tttagcagagttttttgaag

SEQ ID NO: 33398 - DNA, 20 bp, Artificial Sequence
  Description of Artificial Sequence: Synthetic oligonucleotide
  Target: FXN; (+) strand; PAM type: YTN; PAM sequence: CTT
tagcagagttttttgaagac

SEQ ID NO: 33399 - DNA, 20 bp, Artificial Sequence
  Description of Artificial Sequence: Synthetic oligonucleotide
  Target: FXN; (+) strand; PAM type: YTN; PAM sequence: TTT
agcagagttttttgaagacc

SEQ ID NO: 33400 - DNA, 20 bp, Artificial Sequence
  Description of Artificial Sequence: Synthetic oligonucleotide
  Target: FXN; (+) strand; PAM type: YTN; PAM sequence: TTA
gcagagttttttgaagacct

SEQ ID NO: 33401 - DNA, 20 bp, Artificial Sequence
  Description of Artificial Sequence: Synthetic oligonucleotide
  Target: FXN; (+) strand; PAM type: YTN; PAM sequence: TTT
tttgaagaccttgcagacaa

SEQ ID NO: 33402 - DNA, 20 bp, Artificial Sequence
  Description of Artificial Sequence: Synthetic oligonucleotide
  Target: FXN; (+) strand; PAM type: YTN; PAM sequence: TTT
ttgaagaccttgcagacaag

SEQ ID NO: 33403 - DNA, 20 bp, Artificial Sequence
  Description of Artificial Sequence: Synthetic oligonucleotide
  Target: FXN; (+) strand; PAM type: YTN; PAM sequence: TTT
tgaagaccttgcagacaagc

SEQ ID NO: 33404 - DNA, 20 bp, Artificial Sequence
  Description of Artificial Sequence: Synthetic oligonucleotide
  Target: FXN; (+) strand; PAM type: YTN; PAM sequence: TTT
gaagaccttgcagacaagcc

SEQ ID NO: 33405 - DNA, 20 bp, Artificial Sequence
  Description of Artificial Sequence: Synthetic oligonucleotide
  Target: FXN; (+) strand; PAM type: YTN; PAM sequence: TTG
aagaccttgcagacaagcca

SEQ ID NO: 33406 - DNA, 20 bp, Artificial Sequence
  Description of Artificial Sequence: Synthetic oligonucleotide
  Target: FXN; (+) strand; PAM type: YTN; PAM sequence: CTT
gcagacaagccatacacgtt

SEQ ID NO: 33407 - DNA, 20 bp, Artificial Sequence
  Description of Artificial Sequence: Synthetic oligonucleotide
  Target: FXN; (+) strand; PAM type: YTN; PAM sequence: TTG
cagacaagccatacacgttt

SEQ ID NO: 33408 - DNA, 20 bp, Artificial Sequence
  Description of Artificial Sequence: Synthetic oligonucleotide
  Target: FXN; (+) strand; PAM type: YTN; PAM sequence: TTT
gaggactatgatgtctcctt

SEQ ID NO: 33409 - DNA, 20 bp, Artificial Sequence
  Description of Artificial Sequence: Synthetic oligonucleotide
  Target: FXN; (+) strand; PAM type: YTN; PAM sequence: TTG
aggactatgatgtctccttt

SEQ ID NO: 33410 - DNA, 20 bp, Artificial Sequence
  Description of Artificial Sequence: Synthetic oligonucleotide
  Target: FXN; (+) strand; PAM type: YTN; PAM sequence: CTA
tgatgtctcctttggggtac

SEQ ID NO: 33411 - DNA, 20 bp, Artificial Sequence
  Description of Artificial Sequence: Synthetic oligonucleotide
  Target: FXN; (+) strand; PAM type: YTN; PAM sequence: CTC
ctttggggtacctcttgact

SEQ ID NO: 33412 - DNA, 20 bp, Artificial Sequence
  Description of Artificial Sequence: Synthetic oligonucleotide
  Target: FXN; (+) strand; PAM type: YTN; PAM sequence: CTT
tggggtacctcttgacttct

SEQ ID NO: 33413 - DNA, 20 bp, Artificial Sequence
  Description of Artificial Sequence: Synthetic oligonucleotide
  Target: FXN; (+) strand; PAM type: YTN; PAM sequence: TTT
ggggtacctcttgacttctt

SEQ ID NO: 33414 - DNA, 20 bp, Artificial Sequence
  Description of Artificial Sequence: Synthetic oligonucleotide
  Target: FXN; (+) strand; PAM type: YTN; PAM sequence: TTG
gggtacctcttgacttcttt

SEQ ID NO: 33415 - DNA, 20 bp, Artificial Sequence
  Description of Artificial Sequence: Synthetic oligonucleotide
  Target: FXN; (+) strand; PAM type: YTN; PAM sequence: CTC
ttgacttcttttatttttct

SEQ ID NO: 33416 - DNA, 20 bp, Artificial Sequence
  Description of Artificial Sequence: Synthetic oligonucleotide
  Target: FXN; (+) strand; PAM type: YTN; PAM sequence: CTT
gacttcttttatttttctgt

SEQ ID NO: 33417 - DNA, 20 bp, Artificial Sequence
  Description of Artificial Sequence: Synthetic oligonucleotide
  Target: FXN; (+) strand; PAM type: YTN; PAM sequence: TTG
acttcttttatttttctgtt

SEQ ID NO: 33418 - DNA, 20 bp, Artificial Sequence
  Description of Artificial Sequence: Synthetic oligonucleotide
  Target: FXN; (+) strand; PAM type: YTN; PAM sequence: CTT
cttttatttttctgtttccc

SEQ ID NO: 33419 - DNA, 20 bp, Artificial Sequence
  Description of Artificial Sequence: Synthetic oligonucleotide
  Target: FXN; (+) strand; PAM type: YTN; PAM sequence: TTC
ttttatttttctgtttcccc

SEQ ID NO: 33420 - DNA, 20 bp, Artificial Sequence
  Description of Artificial Sequence: Synthetic oligonucleotide
  Target: FXN; (+) strand; PAM type: YTN; PAM sequence: CTT
ttatttttctgtttccccct

SEQ ID NO: 33421 - DNA, 20 bp, Artificial Sequence
  Description of Artificial Sequence: Synthetic oligonucleotide
  Target: FXN; (+) strand; PAM type: YTN; PAM sequence: TTT
tatttttctgtttccccctc

SEQ ID NO: 33422 - DNA, 20 bp, Artificial Sequence
  Description of Artificial Sequence: Synthetic oligonucleotide
  Target: FXN; (+) strand; PAM type: YTN; PAM sequence: TTT
atttttctgtttccccctct

SEQ ID NO: 33423 - DNA, 20 bp, Artificial Sequence
  Description of Artificial Sequence: Synthetic oligonucleotide
  Target: FXN; (+) strand; PAM type: YTN; PAM sequence: TTA
tttttctgtttccccctcta

SEQ ID NO: 33424 - DNA, 20 bp, Artificial Sequence
  Description of Artificial Sequence: Synthetic oligonucleotide
  Target: FXN; (+) strand; PAM type: YTN; PAM sequence: TTT
ttctgtttccccctctaaga

SEQ ID NO: 33425 - DNA, 20 bp, Artificial Sequence
  Description of Artificial Sequence: Synthetic oligonucleotide
  Target: FXN; (+) strand; PAM type: YTN; PAM sequence: TTT
tctgtttccccctctaagaa

SEQ ID NO: 33426 - DNA, 20 bp, Artificial Sequence
  Description of Artificial Sequence: Synthetic oligonucleotide
  Target: FXN; (+) strand; PAM type: YTN; PAM sequence: TTT
ctgtttccccctctaagaat

SEQ ID NO: 33427 - DNA, 20 bp, Artificial Sequence
  Description of Artificial Sequence: Synthetic oligonucleotide
  Target: FXN; (+) strand; PAM type: YTN; PAM sequence: TTC
tgtttccccctctaagaatt

SEQ ID NO: 33428 - DNA, 20 bp, Artificial Sequence
  Description of Artificial Sequence: Synthetic oligonucleotide
  Target: FXN; (+) strand; PAM type: YTN; PAM sequence: CTG
tttccccctctaagaatttt

SEQ ID NO: 33429 - DNA, 20 bp, Artificial Sequence
  Description of Artificial Sequence: Synthetic oligonucleotide
  Target: FXN; (+) strand; PAM type: YTN; PAM sequence: TTT
ccccctctaagaattttagt

SEQ ID NO: 33430 - DNA, 20 bp, Artificial Sequence
  Description of Artificial Sequence: Synthetic oligonucleotide
  Target: FXN; (+) strand; PAM type: YTN; PAM sequence: TTC
cccctctaagaattttagtt

SEQ ID NO: 33431 - DNA, 20 bp, Artificial Sequence
  Description of Artificial Sequence: Synthetic oligonucleotide
  Target: FXN; (+) strand; PAM type: YTN; PAM sequence: CTC
taagaattttagttcactaa

SEQ ID NO: 33432 - DNA, 20 bp, Artificial Sequence
  Description of Artificial Sequence: Synthetic oligonucleotide
  Target: FXN; (+) strand; PAM type: YTN; PAM sequence: CTA
agaattttagttcactaaaa

SEQ ID NO: 33433 - DNA, 20 bp, Artificial Sequence
  Description of Artificial Sequence: Synthetic oligonucleotide
  Target: FXN; (+) strand; PAM type: YTN; PAM sequence: TTT
tagttcactaaaatgaagaa

SEQ ID NO: 33434 - DNA, 20 bp, Artificial Sequence
  Description of Artificial Sequence: Synthetic oligonucleotide
  Target: FXN; (+) strand; PAM type: YTN; PAM sequence: TTT
agttcactaaaatgaagaat

SEQ ID NO: 33435 - DNA, 20 bp, Artificial Sequence
  Description of Artificial Sequence: Synthetic oligonucleotide
  Target: FXN; (+) strand; PAM type: YTN; PAM sequence: TTA
gttcactaaaatgaagaatt

SEQ ID NO: 33436 - DNA, 20 bp, Artificial Sequence
  Description of Artificial Sequence: Synthetic oligonucleotide
  Target: FXN; (+) strand; PAM type: YTN; PAM sequence: TTC
actaaaatgaagaatttccc

SEQ ID NO: 33437 - DNA, 20 bp, Artificial Sequence
  Description of Artificial Sequence: Synthetic oligonucleotide
  Target: FXN; (+) strand; PAM type: YTN; PAM sequence: CTA
aaatgaagaatttccctcca

SEQ ID NO: 33438 - DNA, 20 bp, Artificial Sequence
  Description of Artificial Sequence: Synthetic oligonucleotide
  Target: FXN; (+) strand; PAM type: YTN; PAM sequence: TTT
ccctccagcagagctaagca

SEQ ID NO: 33439 - DNA, 20 bp, Artificial Sequence
  Description of Artificial Sequence: Synthetic oligonucleotide
  Target: FXN; (+) strand; PAM type: YTN; PAM sequence: TTC
cctccagcagagctaagcat

SEQ ID NO: 33440 - DNA, 20 bp, Artificial Sequence
  Description of Artificial Sequence: Synthetic oligonucleotide
  Target: FXN; (+) strand; PAM type: YTN; PAM sequence: CTC
cagcagagctaagcatcaag

SEQ ID NO: 33441 - DNA, 20 bp, Artificial Sequence
  Description of Artificial Sequence: Synthetic oligonucleotide
  Target: FXN; (+) strand; PAM type: YTN; PAM sequence: CTA
agcatcaagtagcatgtagt

SEQ ID NO: 33442 - DNA, 20 bp, Artificial Sequence
  Description of Artificial Sequence: Synthetic oligonucleotide
  Target: FXN; (+) strand; PAM type: YTN; PAM sequence: TTG
taggtaggattaaaagacta

SEQ ID NO: 33443 - DNA, 20 bp, Artificial Sequence
  Description of Artificial Sequence: Synthetic oligonucleotide
  Target: FXN; (+) strand; PAM type: YTN; PAM sequence: TTA
aaagactagggttccgggag

SEQ ID NO: 33444 - DNA, 20 bp, Artificial Sequence
  Description of Artificial Sequence: Synthetic oligonucleotide
  Target: FXN; (+) strand; PAM type: YTN; PAM sequence: CTA
gggttccgggaggtgaaggt

SEQ ID NO: 33445 - DNA, 20 bp, Artificial Sequence
  Description of Artificial Sequence: Synthetic oligonucleotide
  Target: FXN; (+) strand; PAM type: YTN; PAM sequence: TTC
cgggaggtgaaggttgcagt

SEQ ID NO: 33446 - DNA, 20 bp, Artificial Sequence
  Description of Artificial Sequence: Synthetic oligonucleotide
  Target: FXN; (+) strand; PAM type: YTN; PAM sequence: TTG
cagtgagccaaaatcacgcc

SEQ ID NO: 33447 - DNA, 20 bp, Artificial Sequence
  Description of Artificial Sequence: Synthetic oligonucleotide
  Target: FXN; (+) strand; PAM type: YTN; PAM sequence: CTG
cactccagcctgggtgacag

SEQ ID NO: 33448 - DNA, 20 bp, Artificial Sequence
  Description of Artificial Sequence: Synthetic oligonucleotide
  Target: FXN; (+) strand; PAM type: YTN; PAM sequence: CTC
cagcctgggtgacagagcga

SEQ ID NO: 33449 - DNA, 20 bp, Artificial Sequence
  Description of Artificial Sequence: Synthetic oligonucleotide
  Target: FXN; (+) strand; PAM type: YTN; PAM sequence: CTG
ggtgacagagcgagactctg

SEQ ID NO: 33450 - DNA, 20 bp, Artificial Sequence
  Description of Artificial Sequence: Synthetic oligonucleotide
  Target: FXN; (+) strand; PAM type: YTN; PAM sequence: CTC
tgtcatagatggatggatgg

SEQ ID NO: 33451 - DNA, 20 bp, Artificial Sequence
  Description of Artificial Sequence: Synthetic oligonucleotide
  Target: FXN; (+) strand; PAM type: YTN; PAM sequence: CTG
tcatagatggatggatggat

SEQ ID NO: 33452 - DNA, 20 bp, Artificial Sequence
  Description of Artificial Sequence: Synthetic oligonucleotide
  Target: FXN; (+) strand; PAM type: YTN; PAM sequence: CTG
gatagatagataagatagat

SEQ ID NO: 33453 - DNA, 20 bp, Artificial Sequence
  Description of Artificial Sequence: Synthetic oligonucleotide
  Target: FXN; (+) strand; PAM type: YTN; PAM sequence: CTA
ggcttcaagctgcagtccag

SEQ ID NO: 33454 - DNA, 20 bp, Artificial Sequence
  Description of Artificial Sequence: Synthetic oligonucleotide
  Target: FXN; (+) strand; PAM type: YTN; PAM sequence: CTT
caagctgcagtccagctcta

SEQ ID NO: 33455 - DNA, 20 bp, Artificial Sequence
  Description of Artificial Sequence: Synthetic oligonucleotide
  Target: FXN; (+) strand; PAM type: YTN; PAM sequence: TTC
aagctgcagtccagctctac

SEQ ID NO: 33456 - DNA, 20 bp, Artificial Sequence
  Description of Artificial Sequence: Synthetic oligonucleotide
  Target: FXN; (+) strand; PAM type: YTN; PAM sequence: CTG
cagtccagctctaccaggct

SEQ ID NO: 33457 - DNA, 20 bp, Artificial Sequence
  Description of Artificial Sequence: Synthetic oligonucleotide
  Target: FXN; (+) strand; PAM type: YTN; PAM sequence: CTC
taccaggcttgttgtgactc

SEQ ID NO: 33458 - DNA, 20 bp, Artificial Sequence
  Description of Artificial Sequence: Synthetic oligonucleotide
  Target: FXN; (+) strand; PAM type: YTN; PAM sequence: CTA
ccaggcttgttgtgactctg

SEQ ID NO: 33459 - DNA, 20 bp, Artificial Sequence
  Description of Artificial Sequence: Synthetic oligonucleotide
  Target: FXN; (+) strand; PAM type: YTN; PAM sequence: CTT
gttgtgactctgggcaagtc

SEQ ID NO: 33460 - DNA, 20 bp, Artificial Sequence
  Description of Artificial Sequence: Synthetic oligonucleotide
  Target: FXN; (+) strand; PAM type: YTN; PAM sequence: TTG
ttgtgactctgggcaagtca

SEQ ID NO: 33461 - DNA, 20 bp, Artificial Sequence
  Description of Artificial Sequence: Synthetic oligonucleotide
  Target: FXN; (+) strand; PAM type: YTN; PAM sequence: TTG
tgactctgggcaagtcactc

SEQ ID NO: 33462 - DNA, 20 bp, Artificial Sequence
  Description of Artificial Sequence: Synthetic oligonucleotide
  Target: FXN; (+) strand; PAM type: YTN; PAM sequence: CTC
tgggcaagtcactcagcctc

SEQ ID NO: 33463 - DNA, 20 bp, Artificial Sequence
  Description of Artificial Sequence: Synthetic oligonucleotide
  Target: FXN; (+) strand; PAM type: YTN; PAM sequence: CTG
ggcaagtcactcagcctctc

SEQ ID NO: 33464 - DNA, 20 bp, Artificial Sequence
  Description of Artificial Sequence: Synthetic oligonucleotide
  Target: FXN; (+) strand; PAM type: YTN; PAM sequence: CTC
agcctctctgagcctcattt

SEQ ID NO: 33465 - DNA, 20 bp, Artificial Sequence
  Description of Artificial Sequence: Synthetic oligonucleotide
  Target: FXN; (+) strand; PAM type: YTN; PAM sequence: CTC
tctgagcctcattttccagc

SEQ ID NO: 33466 - DNA, 20 bp, Artificial Sequence
  Description of Artificial Sequence: Synthetic oligonucleotide
  Target: FXN; (+) strand; PAM type: YTN; PAM sequence: CTC
tgagcctcattttccagctt

SEQ ID NO: 33467 - DNA, 20 bp, Artificial Sequence
  Description of Artificial Sequence: Synthetic oligonucleotide
  Target: FXN; (+) strand; PAM type: YTN; PAM sequence: CTG
agcctcattttccagcttca

SEQ ID NO: 33468 - DNA, 20 bp, Artificial Sequence
  Description of Artificial Sequence: Synthetic oligonucleotide
  Target: FXN; (+) strand; PAM type: YTN; PAM sequence: CTC
attttccagcttcagtggat

SEQ ID NO: 33469 - DNA, 20 bp, Artificial Sequence
  Description of Artificial Sequence: Synthetic oligonucleotide
  Target: FXN; (+) strand; PAM type: YTN; PAM sequence: TTT
tccagcttcagtggataccc

SEQ ID NO: 33470 - DNA, 20 bp, Artificial Sequence
  Description of Artificial Sequence: Synthetic oligonucleotide
  Target: FXN; (+) strand; PAM type: YTN; PAM sequence: TTT
ccagcttcagtggataccca

SEQ ID NO: 33471 - DNA, 20 bp, Artificial Sequence
  Description of Artificial Sequence: Synthetic oligonucleotide
  Target: FXN; (+) strand; PAM type: YTN; PAM sequence: TTC
cagcttcagtggatacccat

SEQ ID NO: 33472 - DNA, 20 bp, Artificial Sequence
  Description of Artificial Sequence: Synthetic oligonucleotide
  Target: FXN; (+) strand; PAM type: YTN; PAM sequence: CTT
cagtggatacccatgaaggc

SEQ ID NO: 33473 - DNA, 20 bp, Artificial Sequence
  Description of Artificial Sequence: Synthetic oligonucleotide
  Target: FXN; (+) strand; PAM type: YTN; PAM sequence: TTC
agtggatacccatgaaggca

SEQ ID NO: 33474 - DNA, 20 bp, Artificial Sequence
  Description of Artificial Sequence: Synthetic oligonucleotide
  Target: FXN; (+) strand; PAM type: YTN; PAM sequence: CTG
agtgtgtatttgtccagcag

SEQ ID NO: 33475 - DNA, 20 bp, Artificial Sequence
  Description of Artificial Sequence: Synthetic oligonucleotide
  Target: FXN; (+) strand; PAM type: YTN; PAM sequence: TTT
gtccagcaggcagatggagg

SEQ ID NO: 33476 - DNA, 20 bp, Artificial Sequence
  Description of Artificial Sequence: Synthetic oligonucleotide
  Target: FXN; (+) strand; PAM type: YTN; PAM sequence: TTG
tccagcaggcagatggaggg

SEQ ID NO: 33477 - DNA, 20 bp, Artificial Sequence
  Description of Artificial Sequence: Synthetic oligonucleotide
  Target: FXN; (+) strand; PAM type: YTN; PAM sequence: CTA
gacccgtagttcttcagtag

SEQ ID NO: 33478 - DNA, 20 bp, Artificial Sequence
  Description of Artificial Sequence: Synthetic oligonucleotide
  Target: FXN; (+) strand; PAM type: YTN; PAM sequence: TTC
ttcagtagggataagataac

SEQ ID NO: 33479 - DNA, 20 bp, Artificial Sequence
  Description of Artificial Sequence: Synthetic oligonucleotide
  Target: FXN; (+) strand; PAM type: YTN; PAM sequence: CTT
cagtagggataagataactg

SEQ ID NO: 33480 - DNA, 20 bp, Artificial Sequence
  Description of Artificial Sequence: Synthetic oligonucleotide
  Target: FXN; (+) strand; PAM type: YTN; PAM sequence: TTC
agtagggataagataactgc

SEQ ID NO: 33481 - DNA, 20 bp, Artificial Sequence
  Description of Artificial Sequence: Synthetic oligonucleotide
  Target: FXN; (+) strand; PAM type: YTN; PAM sequence: CTG
cccaaaagttatttagatta

SEQ ID NO: 33482 - DNA, 20 bp, Artificial Sequence
  Description of Artificial Sequence: Synthetic oligonucleotide
  Target: FXN; (+) strand; PAM type: YTN; PAM sequence: TTA
tttagattacaaagacttga

SEQ ID NO: 33483 - DNA, 20 bp, Artificial Sequence
  Description of Artificial Sequence: Synthetic oligonucleotide
  Target: FXN; (+) strand; PAM type: YTN; PAM sequence: TTT
agattacaaagacttgagcc

SEQ ID NO: 33484 - DNA, 20 bp, Artificial Sequence
  Description of Artificial Sequence: Synthetic oligonucleotide
  Target: FXN; (+) strand; PAM type: YTN; PAM sequence: TTA
gattacaaagacttgagccc

SEQ ID NO: 33485 - DNA, 20 bp, Artificial Sequence
  Description of Artificial Sequence: Synthetic oligonucleotide
  Target: FXN; (+) strand; PAM type: YTN; PAM sequence: TTA
caaagacttgagccctgctc

SEQ ID NO: 33486 - DNA, 20 bp, Artificial Sequence
  Description of Artificial Sequence: Synthetic oligonucleotide
  Target: FXN; (+) strand; PAM type: YTN; PAM sequence: CTT
gagccctgctcctgtgagac

SEQ ID NO: 33487 - DNA, 20 bp, Artificial Sequence
  Description of Artificial Sequence: Synthetic oligonucleotide
  Target: FXN; (+) strand; PAM type: YTN; PAM sequence: TTG
agccctgctcctgtgagaca

SEQ ID NO: 33488 - DNA, 20 bp, Artificial Sequence
  Description of Artificial Sequence: Synthetic oligonucleotide
  Target: FXN; (+) strand; PAM type: YTN; PAM sequence: CTG
ctcctgtgagacagtgatgg

SEQ ID NO: 33489 - DNA, 20 bp, Artificial Sequence
  Description of Artificial Sequence: Synthetic oligonucleotide
  Target: FXN; (+) strand; PAM type: YTN; PAM sequence: CTC
ctgtgagacagtgatggggt

SEQ ID NO: 33490 - DNA, 20 bp, Artificial Sequence
  Description of Artificial Sequence: Synthetic oligonucleotide
  Target: FXN; (+) strand; PAM type: YTN; PAM sequence: CTG
tgagacagtgatggggtagg

SEQ ID NO: 33491 - DNA, 20 bp, Artificial Sequence
  Description of Artificial Sequence: Synthetic oligonucleotide
  Target: FXN; (+) strand; PAM type: YTN; PAM sequence: TTC
ctgggaagcatatttttgaa

SEQ ID NO: 33492 - DNA, 20 bp, Artificial Sequence
  Description of Artificial Sequence: Synthetic oligonucleotide
  Target: FXN; (+) strand; PAM type: YTN; PAM sequence: CTG
ggaagcatatttttgaaaag

SEQ ID NO: 33493 - DNA, 20 bp, Artificial Sequence
  Description of Artificial Sequence: Synthetic oligonucleotide
  Target: FXN; (+) strand; PAM type: YTN; PAM sequence: TTT
ttgaaaagctcacctgggat

SEQ ID NO: 33494 - DNA, 20 bp, Artificial Sequence
  Description of Artificial Sequence: Synthetic oligonucleotide
  Target: FXN; (+) strand; PAM type: YTN; PAM sequence: TTT
tgaaaagctcacctgggatt

SEQ ID NO: 33495 - DNA, 20 bp, Artificial Sequence
  Description of Artificial Sequence: Synthetic oligonucleotide
  Target: FXN; (+) strand; PAM type: YTN; PAM sequence: TTT
gaaaagctcacctgggattc

SEQ ID NO: 33496 - DNA, 20 bp, Artificial Sequence
  Description of Artificial Sequence: Synthetic oligonucleotide
  Target: FXN; (+) strand; PAM type: YTN; PAM sequence: TTG
aaaagctcacctgggattct

SEQ ID NO: 33497 - DNA, 20 bp, Artificial Sequence
  Description of Artificial Sequence: Synthetic oligonucleotide
  Target: FXN; (+) strand; PAM type: YTN; PAM sequence: CTC
acctgggattctaatgtgta

SEQ ID NO: 33498 - DNA, 20 bp, Artificial Sequence
  Description of Artificial Sequence: Synthetic oligonucleotide
  Target: FXN; (+) strand; PAM type: YTN; PAM sequence: CTG
ggattctaatgtgtatccct

SEQ ID NO: 33499 - DNA, 20 bp, Artificial Sequence
  Description of Artificial Sequence: Synthetic oligonucleotide
  Target: FXN; (+) strand; PAM type: YTN; PAM sequence: TTC
taatgtgtatccctaggtct

SEQ ID NO: 33500 - DNA, 20 bp, Artificial Sequence
  Description of Artificial Sequence: Synthetic oligonucleotide
  Target: FXN; (+) strand; PAM type: YTN; PAM sequence: CTA
atgtgtatccctaggtctta

SEQ ID NO: 33501 - DNA, 20 bp, Artificial Sequence
  Description of Artificial Sequence: Synthetic oligonucleotide
  Target: FXN; (+) strand; PAM type: YTN; PAM sequence: CTA
ggtcttattcctagagattt

SEQ ID NO: 33502 - DNA, 20 bp, Artificial Sequence
  Description of Artificial Sequence: Synthetic oligonucleotide
  Target: FXN; (+) strand; PAM type: YTN; PAM sequence: CTT
attcctagagattttgatta

SEQ ID NO: 33503 - DNA, 20 bp, Artificial Sequence
  Description of Artificial Sequence: Synthetic oligonucleotide
  Target: FXN; (+) strand; PAM type: YTN; PAM sequence: TTA
ttcctagagattttgattac

SEQ ID NO: 33504 - DNA, 20 bp, Artificial Sequence
  Description of Artificial Sequence: Synthetic oligonucleotide
  Target: FXN; (+) strand; PAM type: YTN; PAM sequence: TTC
ctagagattttgattacttg

SEQ ID NO: 33505 - DNA, 20 bp, Artificial Sequence
  Description of Artificial Sequence: Synthetic oligonucleotide
  Target: FXN; (+) strand; PAM type: YTN; PAM sequence: CTA
gagattttgattacttggtc

SEQ ID NO: 33506 - DNA, 20 bp, Artificial Sequence
  Description of Artificial Sequence: Synthetic oligonucleotide
  Target: FXN; (+) strand; PAM type: YTN; PAM sequence: TTT
tgattacttggtctggggtg

SEQ ID NO: 33507 - DNA, 20 bp, Artificial Sequence
  Description of Artificial Sequence: Synthetic oligonucleotide
  Target: FXN; (+) strand; PAM type: YTN; PAM sequence: TTT
gattacttggtctggggtgt

SEQ ID NO: 33508 - DNA, 20 bp, Artificial Sequence
  Description of Artificial Sequence: Synthetic oligonucleotide
  Target: FXN; (+) strand; PAM type: YTN; PAM sequence: TTG
attacttggtctggggtgtg

SEQ ID NO: 33509 - DNA, 20 bp, Artificial Sequence
  Description of Artificial Sequence: Synthetic oligonucleotide
  Target: FXN; (+) strand; PAM type: YTN; PAM sequence: TTA
cttggtctggggtgtggcat

SEQ ID NO: 33510 - DNA, 20 bp, Artificial Sequence
  Description of Artificial Sequence: Synthetic oligonucleotide
  Target: FXN; (+) strand; PAM type: YTN; PAM sequence: CTT
ggtctggggtgtggcatgac

SEQ ID NO: 33511 - DNA, 20 bp, Artificial Sequence
  Description of Artificial Sequence: Synthetic oligonucleotide
  Target: FXN; (+) strand; PAM type: YTN; PAM sequence: TTG
gtctggggtgtggcatgacc

SEQ ID NO: 33512 - DNA, 20 bp, Artificial Sequence
  Description of Artificial Sequence: Synthetic oligonucleotide
  Target: FXN; (+) strand; PAM type: YTN; PAM sequence: CTG
gggtgtggcatgacctgggc

SEQ ID NO: 33513 - DNA, 20 bp, Artificial Sequence
  Description of Artificial Sequence: Synthetic oligonucleotide
  Target: FXN; (+) strand; PAM type: YTN; PAM sequence: CTG
ggcagggcactgggattttt

SEQ ID NO: 33514 - DNA, 20 bp, Artificial Sequence
  Description of Artificial Sequence: Synthetic oligonucleotide
  Target: FXN; (+) strand; PAM type: YTN; PAM sequence: CTG
ggatttttaagctccacaga

SEQ ID NO: 33515 - DNA, 20 bp, Artificial Sequence
  Description of Artificial Sequence: Synthetic oligonucleotide
  Target: FXN; (+) strand; PAM type: YTN; PAM sequence: TTT
ttaagctccacagatgattc

SEQ ID NO: 33516 - DNA, 20 bp, Artificial Sequence
  Description of Artificial Sequence: Synthetic oligonucleotide
  Target: FXN; (+) strand; PAM type: YTN; PAM sequence: TTT
taagctccacagatgattcc

SEQ ID NO: 33517 - DNA, 20 bp, Artificial Sequence
  Description of Artificial Sequence: Synthetic oligonucleotide
  Target: FXN; (+) strand; PAM type: YTN; PAM sequence: TTT
aagctccacagatgattcca

SEQ ID NO: 33518 - DNA, 20 bp, Artificial Sequence
  Description of Artificial Sequence: Synthetic oligonucleotide
  Target: FXN; (+) strand; PAM type: YTN; PAM sequence: TTA
agctccacagatgattccaa

SEQ ID NO: 33519 - DNA, 20 bp, Artificial Sequence
  Description of Artificial Sequence: Synthetic oligonucleotide
  Target: FXN; (+) strand; PAM type: YTN; PAM sequence: CTC
cacagatgattccaatatgc

SEQ ID NO: 33520 - DNA, 20 bp, Artificial Sequence
  Description of Artificial Sequence: Synthetic oligonucleotide
  Target: FXN; (+) strand; PAM type: YTN; PAM sequence: TTC
caatatgcagctagtatgag

SEQ ID NO: 33521 - DNA, 20 bp, Artificial Sequence
  Description of Artificial Sequence: Synthetic oligonucleotide
  Target: FXN; (+) strand; PAM type: YTN; PAM sequence: CTA
gtatgagaacttgttttttt

SEQ ID NO: 33522 - DNA, 20 bp, Artificial Sequence
  Description of Artificial Sequence: Synthetic oligonucleotide
  Target: FXN; (+) strand; PAM type: YTN; PAM sequence: CTT
gtttttttttgaaggagtct

SEQ ID NO: 33523 - DNA, 20 bp, Artificial Sequence
  Description of Artificial Sequence: Synthetic oligonucleotide
  Target: FXN; (+) strand; PAM type: YTN; PAM sequence: TTG
tttttttttgaaggagtctc

SEQ ID NO: 33524 - DNA, 20 bp, Artificial Sequence
  Description of Artificial Sequence: Synthetic oligonucleotide
  Target: FXN; (+) strand; PAM type: YTN; PAM sequence: TTT
ttttttgaaggagtctcact

SEQ ID NO: 33525 - DNA, 20 bp, Artificial Sequence
  Description of Artificial Sequence: Synthetic oligonucleotide
  Target: FXN; (+) strand; PAM type: YTN; PAM sequence: TTT
tttttgaaggagtctcactc

SEQ ID NO: 33526 - DNA, 20 bp, Artificial Sequence
  Description of Artificial Sequence: Synthetic oligonucleotide
  Target: FXN; (+) strand; PAM type: YTN; PAM sequence: TTT
ttttgaaggagtctcactct

SEQ ID NO: 33527 - DNA, 20 bp, Artificial Sequence
  Description of Artificial Sequence: Synthetic oligonucleotide
  Target: FXN; (+) strand; PAM type: YTN; PAM sequence: TTT
tttgaaggagtctcactctg

SEQ ID NO: 33528 - DNA, 20 bp, Artificial Sequence
  Description of Artificial Sequence: Synthetic oligonucleotide
  Target: FXN; (+) strand; PAM type: YTN; PAM sequence: TTT
ttgaaggagtctcactctgt

SEQ ID NO: 33529 - DNA, 20 bp, Artificial Sequence
  Description of Artificial Sequence: Synthetic oligonucleotide
  Target: FXN; (+) strand; PAM type: YTN; PAM sequence: TTT
tgaaggagtctcactctgtc

SEQ ID NO: 33530 - DNA, 20 bp, Artificial Sequence
  Description of Artificial Sequence: Synthetic oligonucleotide
  Target: FXN; (+) strand; PAM type: YTN; PAM sequence: TTT
gaaggagtctcactctgtca

SEQ ID NO: 33531 - DNA, 20 bp, Artificial Sequence
  Description of Artificial Sequence: Synthetic oligonucleotide
  Target: FXN; (+) strand; PAM type: YTN; PAM sequence: TTG
aaggagtctcactctgtcac

SEQ ID NO: 33532 - DNA, 20 bp, Artificial Sequence
  Description of Artificial Sequence: Synthetic oligonucleotide
  Target: FXN; (+) strand; PAM type: YTN; PAM sequence: CTC
actctgtcacccaggctgga

SEQ ID NO: 33533 - DNA, 20 bp, Artificial Sequence
  Description of Artificial Sequence: Synthetic oligonucleotide
  Target: FXN; (+) strand; PAM type: YTN; PAM sequence: CTC
tgtcacccaggctggagtgc

SEQ ID NO: 33534 - DNA, 20 bp, Artificial Sequence
  Description of Artificial Sequence: Synthetic oligonucleotide
  Target: FXN; (+) strand; PAM type: YTN; PAM sequence: CTG
tcacccaggctggagtgcag

SEQ ID NO: 33535 - DNA, 20 bp, Artificial Sequence
  Description of Artificial Sequence: Synthetic oligonucleotide
  Target: FXN; (+) strand; PAM type: YTN; PAM sequence: CTG
gagtgcagtggcgcaatctc

SEQ ID NO: 33536 - DNA, 20 bp, Artificial Sequence
  Description of Artificial Sequence: Synthetic oligonucleotide
  Target: FXN; (+) strand; PAM type: YTN; PAM sequence: CTC
ggctcactgctccgcttcct

SEQ ID NO: 33537 - DNA, 20 bp, Artificial Sequence
  Description of Artificial Sequence: Synthetic oligonucleotide
  Target: FXN; (+) strand; PAM type: YTN; PAM sequence: CTC
actgctccgcttcctgggtt

SEQ ID NO: 33538 - DNA, 20 bp, Artificial Sequence
  Description of Artificial Sequence: Synthetic oligonucleotide
  Target: FXN; (+) strand; PAM type: YTN; PAM sequence: CTG
ctccgcttcctgggttcaag

SEQ ID NO: 33539 - DNA, 20 bp, Artificial Sequence
  Description of Artificial Sequence: Synthetic oligonucleotide
  Target: FXN; (+) strand; PAM type: YTN; PAM sequence: CTC
cgcttcctgggttcaagcag

SEQ ID NO: 33540 - DNA, 20 bp, Artificial Sequence
  Description of Artificial Sequence: Synthetic oligonucleotide
  Target: FXN; (+) strand; PAM type: YTN; PAM sequence: CTT
cctgggttcaagcagttctc

SEQ ID NO: 33541 - DNA, 20 bp, Artificial Sequence
  Description of Artificial Sequence: Synthetic oligonucleotide
  Target: FXN; (+) strand; PAM type: YTN; PAM sequence: TTC
ctgggttcaagcagttctcc

SEQ ID NO: 33542 - DNA, 20 bp, Artificial Sequence
  Description of Artificial Sequence: Synthetic oligonucleotide
  Target: FXN; (+) strand; PAM type: YTN; PAM sequence: CTG
ggttcaagcagttctcctgc

SEQ ID NO: 33543 - DNA, 20 bp, Artificial Sequence
  Description of Artificial Sequence: Synthetic oligonucleotide
  Target: FXN; (+) strand; PAM type: YTN; PAM sequence: TTC
aagcagttctcctgcctcag

SEQ ID NO: 33544 - DNA, 20 bp, Artificial Sequence
  Description of Artificial Sequence: Synthetic oligonucleotide
  Target: FXN; (+) strand; PAM type: YTN; PAM sequence: TTC
tcctgcctcagcctcccgag

SEQ ID NO: 33545 - DNA, 20 bp, Artificial Sequence
  Description of Artificial Sequence: Synthetic oligonucleotide
  Target: FXN; (+) strand; PAM type: YTN; PAM sequence: CTC
ctgcctcagcctcccgagta

SEQ ID NO: 33546 - DNA, 20 bp, Artificial Sequence
  Description of Artificial Sequence: Synthetic oligonucleotide
  Target: FXN; (+) strand; PAM type: YTN; PAM sequence: CTG
cctcagcctcccgagtagct

SEQ ID NO: 33547 - DNA, 20 bp, Artificial Sequence
  Description of Artificial Sequence: Synthetic oligonucleotide
  Target: FXN; (+) strand; PAM type: YTN; PAM sequence: CTC
agcctcccgagtagctggga

SEQ ID NO: 33548 - DNA, 20 bp, Artificial Sequence
  Description of Artificial Sequence: Synthetic oligonucleotide
  Target: FXN; (+) strand; PAM type: YTN; PAM sequence: CTC
ccgagtagctgggattatag

SEQ ID NO: 33549 - DNA, 20 bp, Artificial Sequence
  Description of Artificial Sequence: Synthetic oligonucleotide
  Target: FXN; (+) strand; PAM type: YTN; PAM sequence: CTG
ggattataggcatctgccac

SEQ ID NO: 33550 - DNA, 20 bp, Artificial Sequence
  Description of Artificial Sequence: Synthetic oligonucleotide
  Target: FXN; (+) strand; PAM type: YTN; PAM sequence: TTA
taggcatctgccaccatgcc

SEQ ID NO: 33551 - DNA, 20 bp, Artificial Sequence
  Description of Artificial Sequence: Synthetic oligonucleotide
  Target: FXN; (+) strand; PAM type: YTN; PAM sequence: CTG
ccaccatgcccagctaattt

SEQ ID NO: 33552 - DNA, 20 bp, Artificial Sequence
  Description of Artificial Sequence: Synthetic oligonucleotide
  Target: FXN; (+) strand; PAM type: YTN; PAM sequence: CTA
atttttgcattttagtaaag

SEQ ID NO: 33553 - DNA, 20 bp, Artificial Sequence
  Description of Artificial Sequence: Synthetic oligonucleotide
  Target: FXN; (+) strand; PAM type: YTN; PAM sequence: TTT
ttgcattttagtaaagacgg

SEQ ID NO: 33554 - DNA, 20 bp, Artificial Sequence
  Description of Artificial Sequence: Synthetic oligonucleotide
  Target: FXN; (+) strand; PAM type: YTN; PAM sequence: TTT
tgcattttagtaaagacggg

SEQ ID NO: 33555 - DNA, 20 bp, Artificial Sequence
  Description of Artificial Sequence: Synthetic oligonucleotide
  Target: FXN; (+) strand; PAM type: YTN; PAM sequence: TTT
gcattttagtaaagacgggg

SEQ ID NO: 33556 - DNA, 20 bp, Artificial Sequence
  Description of Artificial Sequence: Synthetic oligonucleotide
  Target: FXN; (+) strand; PAM type: YTN; PAM sequence: TTG
cattttagtaaagacggggt

SEQ ID NO: 33557 - DNA, 20 bp, Artificial Sequence
  Description of Artificial Sequence: Synthetic oligonucleotide
  Target: FXN; (+) strand; PAM type: YTN; PAM sequence: TTT
tagtaaagacggggtttcac

SEQ ID NO: 33558 - DNA, 20 bp, Artificial Sequence
  Description of Artificial Sequence: Synthetic oligonucleotide
  Target: FXN; (+) strand; PAM type: YTN; PAM sequence: TTT
agtaaagacggggtttcacc

SEQ ID NO: 33559 - DNA, 20 bp, Artificial Sequence
  Description of Artificial Sequence: Synthetic oligonucleotide
  Target: FXN; (+) strand; PAM type: YTN; PAM sequence: TTA
gtaaagacggggtttcacca

SEQ ID NO: 33560 - DNA, 20 bp, Artificial Sequence
  Description of Artificial Sequence: Synthetic oligonucleotide
  Target: FXN; (+) strand; PAM type: YTN; PAM sequence: TTT
caccatgttggttaggctgg

SEQ ID NO: 33561 - DNA, 20 bp, Artificial Sequence
  Description of Artificial Sequence: Synthetic oligonucleotide
  Target: FXN; (+) strand; PAM type: YTN; PAM sequence: TTC
accatgttggttaggctggt

SEQ ID NO: 33562 - DNA, 20 bp, Artificial Sequence
  Description of Artificial Sequence: Synthetic oligonucleotide
  Target: FXN; (+) strand; PAM type: YTN; PAM sequence: TTG
gttaggctggtctcgatctc

SEQ ID NO: 33563 - DNA, 20 bp, Artificial Sequence
  Description of Artificial Sequence: Synthetic oligonucleotide
  Target: FXN; (+) strand; PAM type: YTN; PAM sequence: TTA
ggctggtctcgatctcctga

SEQ ID NO: 33564 - DNA, 20 bp, Artificial Sequence
  Description of Artificial Sequence: Synthetic oligonucleotide
  Target: FXN; (+) strand; PAM type: YTN; PAM sequence: CTG
gtctcgatctcctgacctca

SEQ ID NO: 33565 - DNA, 20 bp, Artificial Sequence
  Description of Artificial Sequence: Synthetic oligonucleotide
  Target: FXN; (+) strand; PAM type: YTN; PAM sequence: CTC
gatctcctgacctcaaatgg

SEQ ID NO: 33566 - DNA, 20 bp, Artificial Sequence
  Description of Artificial Sequence: Synthetic oligonucleotide
  Target: FXN; (+) strand; PAM type: YTN; PAM sequence: CTC
ctgacctcaaatggtccacc

SEQ ID NO: 33567 - DNA, 20 bp, Artificial Sequence
  Description of Artificial Sequence: Synthetic oligonucleotide
  Target: FXN; (+) strand; PAM type: YTN; PAM sequence: CTG
acctcaaatggtccaccccc

SEQ ID NO: 33568 - DNA, 20 bp, Artificial Sequence
  Description of Artificial Sequence: Synthetic oligonucleotide
  Target: FXN; (+) strand; PAM type: YTN; PAM sequence: CTC
aaatggtccacccccatcag

SEQ ID NO: 33569 - DNA, 20 bp, Artificial Sequence
  Description of Artificial Sequence: Synthetic oligonucleotide
  Target: FXN; (+) strand; PAM type: YTN; PAM sequence: CTT
ccaaagttttgggataacag

SEQ ID NO: 33570 - DNA, 20 bp, Artificial Sequence
  Description of Artificial Sequence: Synthetic oligonucleotide
  Target: FXN; (+) strand; PAM type: YTN; PAM sequence: TTC
caaagttttgggataacagg

SEQ ID NO: 33571 - DNA, 20 bp, Artificial Sequence
  Description of Artificial Sequence: Synthetic oligonucleotide
  Target: FXN; (+) strand; PAM type: YTN; PAM sequence: TTT
tgggataacaggcgtgagcc

SEQ ID NO: 33572 - DNA, 20 bp, Artificial Sequence
  Description of Artificial Sequence: Synthetic oligonucleotide
  Target: FXN; (+) strand; PAM type: YTN; PAM sequence: TTT
gggataacaggcgtgagcca

SEQ ID NO: 33573 - DNA, 20 bp, Artificial Sequence
  Description of Artificial Sequence: Synthetic oligonucleotide
  Target: FXN; (+) strand; PAM type: YTN; PAM sequence: TTG
ggataacaggcgtgagccac

SEQ ID NO: 33574 - DNA, 20 bp, Artificial Sequence
  Description of Artificial Sequence: Synthetic oligonucleotide
  Target: FXN; (+) strand; PAM type: YTN; PAM sequence: CTG
gtgtgagaacttctgagttg

SEQ ID NO: 33575 - DNA, 20 bp, Artificial Sequence
  Description of Artificial Sequence: Synthetic oligonucleotide
  Target: FXN; (+) strand; PAM type: YTN; PAM sequence: CTT
ctgagttggatgaaacatta

SEQ ID NO: 33576 - DNA, 20 bp, Artificial Sequence
  Description of Artificial Sequence: Synthetic oligonucleotide
  Target: FXN; (+) strand; PAM type: YTN; PAM sequence: TTC
tgagttggatgaaacattag

SEQ ID NO: 33577 - DNA, 20 bp, Artificial Sequence
  Description of Artificial Sequence: Synthetic oligonucleotide
  Target: FXN; (+) strand; PAM type: YTN; PAM sequence: CTG
agttggatgaaacattagcc

SEQ ID NO: 33578 - DNA, 20 bp, Artificial Sequence
  Description of Artificial Sequence: Synthetic oligonucleotide
  Target: FXN; (+) strand; PAM type: YTN; PAM sequence: TTG
gatgaaacattagccccaga

SEQ ID NO: 33579 - DNA, 20 bp, Artificial Sequence
  Description of Artificial Sequence: Synthetic oligonucleotide
  Target: FXN; (+) strand; PAM type: YTN; PAM sequence: TTA
gccccagatcctagaagcca

SEQ ID NO: 33580 - DNA, 20 bp, Artificial Sequence
  Description of Artificial Sequence: Synthetic oligonucleotide
  Target: FXN; (+) strand; PAM type: YTN; PAM sequence: CTA
gaagccagggaagtgctggt

SEQ ID NO: 33581 - DNA, 20 bp, Artificial Sequence
  Description of Artificial Sequence: Synthetic oligonucleotide
  Target: FXN; (+) strand; PAM type: YTN; PAM sequence: CTG
gtctttatcgactggccacc

SEQ ID NO: 33582 - DNA, 20 bp, Artificial Sequence
  Description of Artificial Sequence: Synthetic oligonucleotide
  Target: FXN; (+) strand; PAM type: YTN; PAM sequence: CTT
tatcgactggccaccaggtg

SEQ ID NO: 33583 - DNA, 20 bp, Artificial Sequence
  Description of Artificial Sequence: Synthetic oligonucleotide
  Target: FXN; (+) strand; PAM type: YTN; PAM sequence: TTT
atcgactggccaccaggtgg

SEQ ID NO: 33584 - DNA, 20 bp, Artificial Sequence
  Description of Artificial Sequence: Synthetic oligonucleotide
  Target: FXN; (+) strand; PAM type: YTN; PAM sequence: TTA
tcgactggccaccaggtggc

SEQ ID NO: 33585 - DNA, 20 bp, Artificial Sequence
  Description of Artificial Sequence: Synthetic oligonucleotide
  Target: FXN; (+) strand; PAM type: YTN; PAM sequence: CTG
gccaccaggtggcagatttg

SEQ ID NO: 33586 - DNA, 20 bp, Artificial Sequence
  Description of Artificial Sequence: Synthetic oligonucleotide
  Target: FXN; (+) strand; PAM type: YTN; PAM sequence: TTT
gggcaagggtctgcctttgg

SEQ ID NO: 33587 - DNA, 20 bp, Artificial Sequence
  Description of Artificial Sequence: Synthetic oligonucleotide
  Target: FXN; (+) strand; PAM type: YTN; PAM sequence: TTG
ggcaagggtctgcctttggg

SEQ ID NO: 33588 - DNA, 20 bp, Artificial Sequence
  Description of Artificial Sequence: Synthetic oligonucleotide
  Target: FXN; (+) strand; PAM type: YTN; PAM sequence: CTG
cctttgggtttagaattatt

SEQ ID NO: 33589 - DNA, 20 bp, Artificial Sequence
  Description of Artificial Sequence: Synthetic oligonucleotide
  Target: FXN; (+) strand; PAM type: YTN; PAM sequence: CTT
tgggtttagaattattgctt

SEQ ID NO: 33590 - DNA, 20 bp, Artificial Sequence
  Description of Artificial Sequence: Synthetic oligonucleotide
  Target: FXN; (+) strand; PAM type: YTN; PAM sequence: TTT
gggtttagaattattgctta

SEQ ID NO: 33591 - DNA, 20 bp, Artificial Sequence
  Description of Artificial Sequence: Synthetic oligonucleotide
  Target: FXN; (+) strand; PAM type: YTN; PAM sequence: TTG
ggtttagaattattgcttag

SEQ ID NO: 33592 - DNA, 20 bp, Artificial Sequence
  Description of Artificial Sequence: Synthetic oligonucleotide
  Target: FXN; (+) strand; PAM type: YTN; PAM sequence: TTT
agaattattgcttaggcctt

SEQ ID NO: 33593 - DNA, 20 bp, Artificial Sequence
  Description of Artificial Sequence: Synthetic oligonucleotide
  Target: FXN; (+) strand; PAM type: YTN; PAM sequence: TTA
gaattattgcttaggcctta

SEQ ID NO: 33594 - DNA, 20 bp, Artificial Sequence
  Description of Artificial Sequence: Synthetic oligonucleotide
  Target: FXN; (+) strand; PAM type: YTN; PAM sequence: TTA
ttgcttaggccttaaagtag

SEQ ID NO: 33595 - DNA, 20 bp, Artificial Sequence
  Description of Artificial Sequence: Synthetic oligonucleotide
  Target: FXN; (+) strand; PAM type: YTN; PAM sequence: TTG
cttaggccttaaagtagttc

SEQ ID NO: 33596 - DNA, 20 bp, Artificial Sequence
  Description of Artificial Sequence: Synthetic oligonucleotide
  Target: FXN; (+) strand; PAM type: YTN; PAM sequence: CTT
aggccttaaagtagttcttt

SEQ ID NO: 33597 - DNA, 20 bp, Artificial Sequence
  Description of Artificial Sequence: Synthetic oligonucleotide
  Target: FXN; (+) strand; PAM type: YTN; PAM sequence: TTA
ggccttaaagtagttctttt

SEQ ID NO: 33598 - DNA, 20 bp, Artificial Sequence
  Description of Artificial Sequence: Synthetic oligonucleotide
  Target: FXN; (+) strand; PAM type: YTN; PAM sequence: CTT
aaagtagttcttttttgcca

SEQ ID NO: 33599 - DNA, 20 bp, Artificial Sequence
  Description of Artificial Sequence: Synthetic oligonucleotide
  Target: FXN; (+) strand; PAM type: YTN; PAM sequence: TTA
aagtagttcttttttgccag

SEQ ID NO: 33600 - DNA, 20 bp, Artificial Sequence
  Description of Artificial Sequence: Synthetic oligonucleotide
  Target: FXN; (+) strand; PAM type: YTN; PAM sequence: TTC
ttttttgccagtgggagaaa

SEQ ID NO: 33601 - DNA, 20 bp, Artificial Sequence
  Description of Artificial Sequence: Synthetic oligonucleotide
  Target: FXN; (+) strand; PAM type: YTN; PAM sequence: CTT
ttttgccagtgggagaaaat

SEQ ID NO: 33602 - DNA, 20 bp, Artificial Sequence
  Description of Artificial Sequence: Synthetic oligonucleotide
  Target: FXN; (+) strand; PAM type: YTN; PAM sequence: TTT
tttgccagtgggagaaaatc

SEQ ID NO: 33603 - DNA, 20 bp, Artificial Sequence
  Description of Artificial Sequence: Synthetic oligonucleotide
  Target: FXN; (+) strand; PAM type: YTN; PAM sequence: TTT
ttgccagtgggagaaaatcc

SEQ ID NO: 33604 - DNA, 20 bp, Artificial Sequence
  Description of Artificial Sequence: Synthetic oligonucleotide
  Target: FXN; (+) strand; PAM type: YTN; PAM sequence: TTT
tgccagtgggagaaaatccc

SEQ ID NO: 33605 - DNA, 20 bp, Artificial Sequence
  Description of Artificial Sequence: Synthetic oligonucleotide
  Target: FXN; (+) strand; PAM type: YTN; PAM sequence: TTT
gccagtgggagaaaatccct

SEQ ID NO: 33606 - DNA, 20 bp, Artificial Sequence
  Description of Artificial Sequence: Synthetic oligonucleotide
  Target: FXN; (+) strand; PAM type: YTN; PAM sequence: TTG
ccagtgggagaaaatccctc

SEQ ID NO: 33607 - DNA, 20 bp, Artificial Sequence
  Description of Artificial Sequence: Synthetic oligonucleotide
  Target: FXN; (+) strand; PAM type: YTN; PAM sequence: CTC
aaagatggttttctgggttg

SEQ ID NO: 33608 - DNA, 20 bp, Artificial Sequence
  Description of Artificial Sequence: Synthetic oligonucleotide
  Target: FXN; (+) strand; PAM type: YTN; PAM sequence: TTT
tctgggttggttggtttgtt

SEQ ID NO: 33609 - DNA, 20 bp, Artificial Sequence
  Description of Artificial Sequence: Synthetic oligonucleotide
  Target: FXN; (+) strand; PAM type: YTN; PAM sequence: TTT
ctgggttggttggtttgttt

SEQ ID NO: 33610 - DNA, 20 bp, Artificial Sequence
  Description of Artificial Sequence: Synthetic oligonucleotide
  Target: FXN; (+) strand; PAM type: YTN; PAM sequence: TTC
tgggttggttggtttgtttg

SEQ ID NO: 33611 - DNA, 20 bp, Artificial Sequence
  Description of Artificial Sequence: Synthetic oligonucleotide
  Target: FXN; (+) strand; PAM type: YTN; PAM sequence: CTG
ggttggttggtttgtttgtc

SEQ ID NO: 33612 - DNA, 20 bp, Artificial Sequence
  Description of Artificial Sequence: Synthetic oligonucleotide
  Target: FXN; (+) strand; PAM type: YTN; PAM sequence: TTG
gttggtttgtttgtctgttt

SEQ ID NO: 33613 - DNA, 20 bp, Artificial Sequence
  Description of Artificial Sequence: Synthetic oligonucleotide
  Target: FXN; (+) strand; PAM type: YTN; PAM sequence: TTG
gtttgtttgtctgtttgttt

SEQ ID NO: 33614 - DNA, 20 bp, Artificial Sequence
  Description of Artificial Sequence: Synthetic oligonucleotide
  Target: FXN; (+) strand; PAM type: YTN; PAM sequence: TTT
gtttgtctgtttgtttgttt

SEQ ID NO: 33615 - DNA, 20 bp, Artificial Sequence
  Description of Artificial Sequence: Synthetic oligonucleotide
  Target: FXN; (+) strand; PAM type: YTN; PAM sequence: TTG
tttgtctgtttgtttgtttt

SEQ ID NO: 33616 - DNA, 20 bp, Artificial Sequence
  Description of Artificial Sequence: Synthetic oligonucleotide
  Target: FXN; (+) strand; PAM type: YTN; PAM sequence: TTT
gtctgtttgtttgttttttg

SEQ ID NO: 33617 - DNA, 20 bp, Artificial Sequence
  Description of Artificial Sequence: Synthetic oligonucleotide
  Target: FXN; (+) strand; PAM type: YTN; PAM sequence: TTG
tctgtttgtttgttttttga

SEQ ID NO: 33618 - DNA, 20 bp, Artificial Sequence
  Description of Artificial Sequence: Synthetic oligonucleotide
  Target: FXN; (+) strand; PAM type: YTN; PAM sequence: CTG
tttgtttgttttttgagaca

SEQ ID NO: 33619 - DNA, 20 bp, Artificial Sequence
  Description of Artificial Sequence: Synthetic oligonucleotide
  Target: FXN; (+) strand; PAM type: YTN; PAM sequence: TTT
gtttgttttttgagacagag

SEQ ID NO: 33620 - DNA, 20 bp, Artificial Sequence
  Description of Artificial Sequence: Synthetic oligonucleotide
  Target: FXN; (+) strand; PAM type: YTN; PAM sequence: TTG
tttgttttttgagacagagt

SEQ ID NO: 33621 - DNA, 20 bp, Artificial Sequence
  Description of Artificial Sequence: Synthetic oligonucleotide
  Target: FXN; (+) strand; PAM type: YTN; PAM sequence: TTT
gttttttgagacagagtctc

SEQ ID NO: 33622 - DNA, 20 bp, Artificial Sequence
  Description of Artificial Sequence: Synthetic oligonucleotide
  Target: FXN; (+) strand; PAM type: YTN; PAM sequence: TTG
ttttttgagacagagtctcc

SEQ ID NO: 33623 - DNA, 20 bp, Artificial Sequence
  Description of Artificial Sequence: Synthetic oligonucleotide
  Target: FXN; (+) strand; PAM type: YTN; PAM sequence: TTT
tttgagacagagtctccctc

SEQ ID NO: 33624 - DNA, 20 bp, Artificial Sequence
  Description of Artificial Sequence: Synthetic oligonucleotide
  Target: FXN; (+) strand; PAM type: YTN; PAM sequence: TTT
ttgagacagagtctccctct

SEQ ID NO: 33625 - DNA, 20 bp, Artificial Sequence
  Description of Artificial Sequence: Synthetic oligonucleotide
  Target: FXN; (+) strand; PAM type: YTN; PAM sequence: TTT
tgagacagagtctccctctg

SEQ ID NO: 33626 - DNA, 20 bp, Artificial Sequence
  Description of Artificial Sequence: Synthetic oligonucleotide
  Target: FXN; (+) strand; PAM type: YTN; PAM sequence: TTT
gagacagagtctccctctgt

SEQ ID NO: 33627 - DNA, 20 bp, Artificial Sequence
  Description of Artificial Sequence: Synthetic oligonucleotide
  Target: FXN; (+) strand; PAM type: YTN; PAM sequence: TTG
agacagagtctccctctgtt

SEQ ID NO: 33628 - DNA, 20 bp, Artificial Sequence
  Description of Artificial Sequence: Synthetic oligonucleotide
  Target: FXN; (+) strand; PAM type: YTN; PAM sequence: CTC
cctctgttattcagcctgga

SEQ ID NO: 33629 - DNA, 20 bp, Artificial Sequence
  Description of Artificial Sequence: Synthetic oligonucleotide
  Target: FXN; (+) strand; PAM type: YTN; PAM sequence: CTC
tgttattcagcctggagtgc

SEQ ID NO: 33630 - DNA, 20 bp, Artificial Sequence
  Description of Artificial Sequence: Synthetic oligonucleotide
  Target: FXN; (+) strand; PAM type: YTN; PAM sequence: CTG
ttattcagcctggagtgcag

SEQ ID NO: 33631 - DNA, 20 bp, Artificial Sequence
  Description of Artificial Sequence: Synthetic oligonucleotide
  Target: FXN; (+) strand; PAM type: YTN; PAM sequence: TTA
ttcagcctggagtgcagtgg

SEQ ID NO: 33632 - DNA, 20 bp, Artificial Sequence
  Description of Artificial Sequence: Synthetic oligonucleotide
  Target: FXN; (+) strand; PAM type: YTN; PAM sequence: TTC
agcctggagtgcagtggcat

SEQ ID NO: 33633 - DNA, 20 bp, Artificial Sequence
  Description of Artificial Sequence: Synthetic oligonucleotide
  Target: FXN; (+) strand; PAM type: YTN; PAM sequence: CTG
gagtgcagtggcatgatctc

SEQ ID NO: 33634 - DNA, 20 bp, Artificial Sequence
  Description of Artificial Sequence: Synthetic oligonucleotide
  Target: FXN; (+) strand; PAM type: YTN; PAM sequence: CTC
actgcaacctctgcctctcg

SEQ ID NO: 33635 - DNA, 20 bp, Artificial Sequence
  Description of Artificial Sequence: Synthetic oligonucleotide
  Target: FXN; (+) strand; PAM type: YTN; PAM sequence: CTG
caacctctgcctctcgggtt

SEQ ID NO: 33636 - DNA, 20 bp, Artificial Sequence
  Description of Artificial Sequence: Synthetic oligonucleotide
  Target: FXN; (+) strand; PAM type: YTN; PAM sequence: CTC
tgcctctcgggttcaagcag

SEQ ID NO: 33637 - DNA, 20 bp, Artificial Sequence
  Description of Artificial Sequence: Synthetic oligonucleotide
  Target: FXN; (+) strand; PAM type: YTN; PAM sequence: CTG
cctctcgggttcaagcagtt

SEQ ID NO: 33638 - DNA, 20 bp, Artificial Sequence
  Description of Artificial Sequence: Synthetic oligonucleotide
  Target: FXN; (+) strand; PAM type: YTN; PAM sequence: CTC
tcgggttcaagcagttctcc

SEQ ID NO: 33639 - DNA, 20 bp, Artificial Sequence
  Description of Artificial Sequence: Synthetic oligonucleotide
  Target: FXN; (+) strand; PAM type: YTN; PAM sequence: CTC
gggttcaagcagttctcctg

SEQ ID NO: 33640 - DNA, 20 bp, Artificial Sequence
  Description of Artificial Sequence: Synthetic oligonucleotide
  Target: FXN; (+) strand; PAM type: YTN; PAM sequence: TTC
aagcagttctcctgcctcaa

SEQ ID NO: 33641 - DNA, 20 bp, Artificial Sequence
  Description of Artificial Sequence: Synthetic oligonucleotide
  Target: FXN; (+) strand; PAM type: YTN; PAM sequence: TTC
tcctgcctcaacctcccaag

SEQ ID NO: 33642 - DNA, 20 bp, Artificial Sequence
  Description of Artificial Sequence: Synthetic oligonucleotide
  Target: FXN; (+) strand; PAM type: YTN; PAM sequence: CTC
ctgcctcaacctcccaagta

SEQ ID NO: 33643 - DNA, 20 bp, Artificial Sequence
  Description of Artificial Sequence: Synthetic oligonucleotide
  Target: FXN; (+) strand; PAM type: YTN; PAM sequence: CTG
cctcaacctcccaagtagct

SEQ ID NO: 33644 - DNA, 20 bp, Artificial Sequence
  Description of Artificial Sequence: Synthetic oligonucleotide
  Target: FXN; (+) strand; PAM type: YTN; PAM sequence: CTC
aacctcccaagtagctggaa

SEQ ID NO: 33645 - DNA, 20 bp, Artificial Sequence
  Description of Artificial Sequence: Synthetic oligonucleotide
  Target: FXN; (+) strand; PAM type: YTN; PAM sequence: CTC
ccaagtagctggaattatag

SEQ ID NO: 33646 - DNA, 20 bp, Artificial Sequence
  Description of Artificial Sequence: Synthetic oligonucleotide
  Target: FXN; (+) strand; PAM type: YTN; PAM sequence: CTG
gaattataggcacacgcccc

SEQ ID NO: 33647 - DNA, 20 bp, Artificial Sequence
  Description of Artificial Sequence: Synthetic oligonucleotide
  Target: FXN; (+) strand; PAM type: YTN; PAM sequence: TTA
taggcacacgcccccacacc

SEQ ID NO: 33648 - DNA, 20 bp, Artificial Sequence
  Description of Artificial Sequence: Synthetic oligonucleotide
  Target: FXN; (+) strand; PAM type: YTN; PAM sequence: CTA
atttttgtatttttagtaga

SEQ ID NO: 33649 - DNA, 20 bp, Artificial Sequence
  Description of Artificial Sequence: Synthetic oligonucleotide
  Target: FXN; (+) strand; PAM type: YTN; PAM sequence: TTT
ttgtatttttagtagagaca

SEQ ID NO: 33650 - DNA, 20 bp, Artificial Sequence
  Description of Artificial Sequence: Synthetic oligonucleotide
  Target: FXN; (+) strand; PAM type: YTN; PAM sequence: TTT
tgtatttttagtagagacag

SEQ ID NO: 33651 - DNA, 20 bp, Artificial Sequence
  Description of Artificial Sequence: Synthetic oligonucleotide
  Target: FXN; (+) strand; PAM type: YTN; PAM sequence: TTT
gtatttttagtagagacagt

SEQ ID NO: 33652 - DNA, 20 bp, Artificial Sequence
  Description of Artificial Sequence: Synthetic oligonucleotide
  Target: FXN; (+) strand; PAM type: YTN; PAM sequence: TTG
tatttttagtagagacagtg

SEQ ID NO: 33653 - DNA, 20 bp, Artificial Sequence
  Description of Artificial Sequence: Synthetic oligonucleotide
  Target: FXN; (+) strand; PAM type: YTN; PAM sequence: TTT
ttagtagagacagtgtttca

SEQ ID NO: 33654 - DNA, 20 bp, Artificial Sequence
  Description of Artificial Sequence: Synthetic oligonucleotide
  Target: FXN; (+) strand; PAM type: YTN; PAM sequence: TTT
tagtagagacagtgtttcac

SEQ ID NO: 33655 - DNA, 20 bp, Artificial Sequence
  Description of Artificial Sequence: Synthetic oligonucleotide
  Target: FXN; (+) strand; PAM type: YTN; PAM sequence: TTT
agtagagacagtgtttcacc

SEQ ID NO: 33656 - DNA, 20 bp, Artificial Sequence
  Description of Artificial Sequence: Synthetic oligonucleotide
  Target: FXN; (+) strand; PAM type: YTN; PAM sequence: TTA
gtagagacagtgtttcacca

SEQ ID NO: 33657 - DNA, 20 bp, Artificial Sequence
  Description of Artificial Sequence: Synthetic oligonucleotide
  Target: FXN; (+) strand; PAM type: YTN; PAM sequence: TTT
caccacgttggccaggctgg

SEQ ID NO: 33658 - DNA, 20 bp, Artificial Sequence
  Description of Artificial Sequence: Synthetic oligonucleotide
  Target: FXN; (+) strand; PAM type: YTN; PAM sequence: TTC
accacgttggccaggctggt

SEQ ID NO: 33659 - DNA, 20 bp, Artificial Sequence
  Description of Artificial Sequence: Synthetic oligonucleotide
  Target: FXN; (+) strand; PAM type: YTN; PAM sequence: TTG
gccaggctggttttgaactc

SEQ ID NO: 33660 - DNA, 20 bp, Artificial Sequence
  Description of Artificial Sequence: Synthetic oligonucleotide
  Target: FXN; (+) strand; PAM type: YTN; PAM sequence: CTG
gttttgaactcctgaactca

SEQ ID NO: 33661 - DNA, 20 bp, Artificial Sequence
  Description of Artificial Sequence: Synthetic oligonucleotide
  Target: FXN; (+) strand; PAM type: YTN; PAM sequence: TTT
tgaactcctgaactcaagta

SEQ ID NO: 33662 - DNA, 20 bp, Artificial Sequence
  Description of Artificial Sequence: Synthetic oligonucleotide
  Target: FXN; (+) strand; PAM type: YTN; PAM sequence: TTT
gaactcctgaactcaagtaa

SEQ ID NO: 33663 - DNA, 20 bp, Artificial Sequence
  Description of Artificial Sequence: Synthetic oligonucleotide
  Target: FXN; (+) strand; PAM type: YTN; PAM sequence: TTG
aactcctgaactcaagtaat

SEQ ID NO: 33664 - DNA, 20 bp, Artificial Sequence
  Description of Artificial Sequence: Synthetic oligonucleotide
  Target: FXN; (+) strand; PAM type: YTN; PAM sequence: CTC
ctgaactcaagtaatcctcc

SEQ ID NO: 33665 - DNA, 20 bp, Artificial Sequence
  Description of Artificial Sequence: Synthetic oligonucleotide
  Target: FXN; (+) strand; PAM type: YTN; PAM sequence: CTG
aactcaagtaatcctcccac

SEQ ID NO: 33666 - DNA, 20 bp, Artificial Sequence
  Description of Artificial Sequence: Synthetic oligonucleotide
  Target: FXN; (+) strand; PAM type: YTN; PAM sequence: CTC
aagtaatcctcccacctcag

SEQ ID NO: 33667 - DNA, 20 bp, Artificial Sequence
  Description of Artificial Sequence: Synthetic oligonucleotide
  Target: FXN; (+) strand; PAM type: YTN; PAM sequence: CTC
ccacctcagcctcccaaagt

SEQ ID NO: 33668 - DNA, 20 bp, Artificial Sequence
  Description of Artificial Sequence: Synthetic oligonucleotide
  Target: FXN; (+) strand; PAM type: YTN; PAM sequence: CTC
agcctcccaaagtgctagga

SEQ ID NO: 33669 - DNA, 20 bp, Artificial Sequence
  Description of Artificial Sequence: Synthetic oligonucleotide
  Target: FXN; (+) strand; PAM type: YTN; PAM sequence: CTC
ccaaagtgctaggattacag

SEQ ID NO: 33670 - DNA, 20 bp, Artificial Sequence
  Description of Artificial Sequence: Synthetic oligonucleotide
  Target: FXN; (+) strand; PAM type: YTN; PAM sequence: CTA
ggattacaggtgtgagccac

SEQ ID NO: 33671 - DNA, 20 bp, Artificial Sequence
  Description of Artificial Sequence: Synthetic oligonucleotide
  Target: FXN; (+) strand; PAM type: YTN; PAM sequence: TTA
caggtgtgagccaccgcgcc

SEQ ID NO: 33672 - DNA, 20 bp, Artificial Sequence
  Description of Artificial Sequence: Synthetic oligonucleotide
  Target: FXN; (+) strand; PAM type: YTN; PAM sequence: CTG
gctcctcaaagatgttaatc

SEQ ID NO: 33673 - DNA, 20 bp, Artificial Sequence
  Description of Artificial Sequence: Synthetic oligonucleotide
  Target: FXN; (+) strand; PAM type: YTN; PAM sequence: CTC
ctcaaagatgttaatcctct

SEQ ID NO: 33674 - DNA, 20 bp, Artificial Sequence
  Description of Artificial Sequence: Synthetic oligonucleotide
  Target: FXN; (+) strand; PAM type: YTN; PAM sequence: CTC
aaagatgttaatcctcttga

SEQ ID NO: 33675 - DNA, 20 bp, Artificial Sequence
  Description of Artificial Sequence: Synthetic oligonucleotide
  Target: FXN; (+) strand; PAM type: YTN; PAM sequence: TTA
atcctcttgatggcaattga

SEQ ID NO: 33676 - DNA, 20 bp, Artificial Sequence
  Description of Artificial Sequence: Synthetic oligonucleotide
  Target: FXN; (+) strand; PAM type: YTN; PAM sequence: CTC
ttgatggcaattgactaata

SEQ ID NO: 33677 - DNA, 20 bp, Artificial Sequence
  Description of Artificial Sequence: Synthetic oligonucleotide
  Target: FXN; (+) strand; PAM type: YTN; PAM sequence: CTT
gatggcaattgactaatacc

SEQ ID NO: 33678 - DNA, 20 bp, Artificial Sequence
  Description of Artificial Sequence: Synthetic oligonucleotide
  Target: FXN; (+) strand; PAM type: YTN; PAM sequence: TTG
atggcaattgactaatacca

SEQ ID NO: 33679 - DNA, 20 bp, Artificial Sequence
  Description of Artificial Sequence: Synthetic oligonucleotide
  Target: FXN; (+) strand; PAM type: YTN; PAM sequence: TTG
actaataccagaaaatgtca

SEQ ID NO: 33680 - DNA, 20 bp, Artificial Sequence
  Description of Artificial Sequence: Synthetic oligonucleotide
  Target: FXN; (+) strand; PAM type: YTN; PAM sequence: CTA
ataccagaaaatgtcacgaa

SEQ ID NO: 33681 - DNA, 20 bp, Artificial Sequence
  Description of Artificial Sequence: Synthetic oligonucleotide
  Target: FXN; (+) strand; PAM type: YTN; PAM sequence: TTT
tggattcaatcatggaattg

SEQ ID NO: 33682 - DNA, 20 bp, Artificial Sequence
  Description of Artificial Sequence: Synthetic oligonucleotide
  Target: FXN; (+) strand; PAM type: YTN; PAM sequence: TTT
ggattcaatcatggaattgt

SEQ ID NO: 33683 - DNA, 20 bp, Artificial Sequence
  Description of Artificial Sequence: Synthetic oligonucleotide
  Target: FXN; (+) strand; PAM type: YTN; PAM sequence: TTG
gattcaatcatggaattgtt

SEQ ID NO: 33684 - DNA, 20 bp, Artificial Sequence
  Description of Artificial Sequence: Synthetic oligonucleotide
  Target: FXN; (+) strand; PAM type: YTN; PAM sequence: TTC
aatcatggaattgttgagga

SEQ ID NO: 33685 - DNA, 20 bp, Artificial Sequence
  Description of Artificial Sequence: Synthetic oligonucleotide
  Target: FXN; (+) strand; PAM type: YTN; PAM sequence: TTG
ttgaggacaatcagccatca

SEQ ID NO: 33686 - DNA, 20 bp, Artificial Sequence
  Description of Artificial Sequence: Synthetic oligonucleotide
  Target: FXN; (+) strand; PAM type: YTN; PAM sequence: TTG
aggacaatcagccatcagac

SEQ ID NO: 33687 - DNA, 20 bp, Artificial Sequence
  Description of Artificial Sequence: Synthetic oligonucleotide
  Target: FXN; (+) strand; PAM type: YTN; PAM sequence: CTA
aagcgatagaaatagtattg

SEQ ID NO: 33688 - DNA, 20 bp, Artificial Sequence
  Description of Artificial Sequence: Synthetic oligonucleotide
  Target: FXN; (+) strand; PAM type: YTN; PAM sequence: TTG
gaaattgcagcgggagcact

SEQ ID NO: 33689 - DNA, 20 bp, Artificial Sequence
  Description of Artificial Sequence: Synthetic oligonucleotide
  Target: FXN; (+) strand; PAM type: YTN; PAM sequence: TTG
cagcgggagcactgaatgga

SEQ ID NO: 33690 - DNA, 20 bp, Artificial Sequence
  Description of Artificial Sequence: Synthetic oligonucleotide
  Target: FXN; (+) strand; PAM type: YTN; PAM sequence: CTG
aatggagaaggcactccaca

SEQ ID NO: 33691 - DNA, 20 bp, Artificial Sequence
  Description of Artificial Sequence: Synthetic oligonucleotide
  Target: FXN; (+) strand; PAM type: YTN; PAM sequence: CTC
cacataatggaggaggcaac

SEQ ID NO: 33692 - DNA, 20 bp, Artificial Sequence
  Description of Artificial Sequence: Synthetic oligonucleotide
  Target: FXN; (+) strand; PAM type: YTN; PAM sequence: CTT
agagaaggtatcaagcctga

SEQ ID NO: 33693 - DNA, 20 bp, Artificial Sequence
  Description of Artificial Sequence: Synthetic oligonucleotide
  Target: FXN; (+) strand; PAM type: YTN; PAM sequence: TTA
gagaaggtatcaagcctgac

SEQ ID NO: 33694 - DNA, 20 bp, Artificial Sequence
  Description of Artificial Sequence: Synthetic oligonucleotide
  Target: FXN; (+) strand; PAM type: YTN; PAM sequence: CTG
actataaggacagtgaggga

SEQ ID NO: 33695 - DNA, 20 bp, Artificial Sequence
  Description of Artificial Sequence: Synthetic oligonucleotide
  Target: FXN; (+) strand; PAM type: YTN; PAM sequence: CTA
taaggacagtgagggaattg

SEQ ID NO: 33696 - DNA, 20 bp, Artificial Sequence
  Description of Artificial Sequence: Synthetic oligonucleotide
  Target: FXN; (+) strand; PAM type: YTN; PAM sequence: TTG
aaaaaacaaaaaaggagcaa

SEQ ID NO: 33697 - DNA, 20 bp, Artificial Sequence
  Description of Artificial Sequence: Synthetic oligonucleotide
  Target: FXN; (+) strand; PAM type: YTN; PAM sequence: TTG
aatgcctttcaagtagattc

SEQ ID NO: 33698 - DNA, 20 bp, Artificial Sequence
  Description of Artificial Sequence: Synthetic oligonucleotide
  Target: FXN; (+) strand; PAM type: YTN; PAM sequence: CTT
tcaagtagattcagtaattg

SEQ ID NO: 33699 - DNA, 20 bp, Artificial Sequence
  Description of Artificial Sequence: Synthetic oligonucleotide
  Target: FXN; (+) strand; PAM type: YTN; PAM sequence: TTT
caagtagattcagtaattgc

SEQ ID NO: 33700 - DNA, 20 bp, Artificial Sequence
  Description of Artificial Sequence: Synthetic oligonucleotide
  Target: FXN; (+) strand; PAM type: YTN; PAM sequence: TTC
aagtagattcagtaattgct

SEQ ID NO: 33701 - DNA, 20 bp, Artificial Sequence
  Description of Artificial Sequence: Synthetic oligonucleotide
  Target: FXN; (+) strand; PAM type: YTN; PAM sequence: TTC
agtaattgctgttagcagca

SEQ ID NO: 33702 - DNA, 20 bp, Artificial Sequence
  Description of Artificial Sequence: Synthetic oligonucleotide
  Target: FXN; (+) strand; PAM type: YTN; PAM sequence: TTG
ctgttagcagcaaaaaatgc

SEQ ID NO: 33703 - DNA, 20 bp, Artificial Sequence
  Description of Artificial Sequence: Synthetic oligonucleotide
  Target: FXN; (+) strand; PAM type: YTN; PAM sequence: CTG
ttagcagcaaaaaatgcagt

SEQ ID NO: 33704 - DNA, 20 bp, Artificial Sequence
  Description of Artificial Sequence: Synthetic oligonucleotide
  Target: FXN; (+) strand; PAM type: YTN; PAM sequence: TTA
gcagcaaaaaatgcagtagt

SEQ ID NO: 33705 - DNA, 20 bp, Artificial Sequence
  Description of Artificial Sequence: Synthetic oligonucleotide
  Target: FXN; (+) strand; PAM type: YTN; PAM sequence: CTG
ggcagggctttaaagtgctt

SEQ ID NO: 33706 - DNA, 20 bp, Artificial Sequence
  Description of Artificial Sequence: Synthetic oligonucleotide
  Target: FXN; (+) strand; PAM type: YTN; PAM sequence: CTT
taaagtgcttgcacaggcag

SEQ ID NO: 33707 - DNA, 20 bp, Artificial Sequence
  Description of Artificial Sequence: Synthetic oligonucleotide
  Target: FXN; (+) strand; PAM type: YTN; PAM sequence: TTT
aaagtgcttgcacaggcagc

SEQ ID NO: 33708 - DNA, 20 bp, Artificial Sequence
  Description of Artificial Sequence: Synthetic oligonucleotide
  Target: FXN; (+) strand; PAM type: YTN; PAM sequence: TTA
aagtgcttgcacaggcagcc

SEQ ID NO: 33709 - DNA, 20 bp, Artificial Sequence
  Description of Artificial Sequence: Synthetic oligonucleotide
  Target: FXN; (+) strand; PAM type: YTN; PAM sequence: CTT
gcacaggcagccctagaggg

SEQ ID NO: 33710 - DNA, 20 bp, Artificial Sequence
  Description of Artificial Sequence: Synthetic oligonucleotide
  Target: FXN; (+) strand; PAM type: YTN; PAM sequence: TTG
cacaggcagccctagagggc

SEQ ID NO: 33711 - DNA, 20 bp, Artificial Sequence
  Description of Artificial Sequence: Synthetic oligonucleotide
  Target: FXN; (+) strand; PAM type: YTN; PAM sequence: CTA
gagggccgggctgcttggga

SEQ ID NO: 33712 - DNA, 20 bp, Artificial Sequence
  Description of Artificial Sequence: Synthetic oligonucleotide
  Target: FXN; (+) strand; PAM type: YTN; PAM sequence: CTG
cttgggaactcttacaaact

SEQ ID NO: 33713 - DNA, 20 bp, Artificial Sequence
  Description of Artificial Sequence: Synthetic oligonucleotide
  Target: FXN; (+) strand; PAM type: YTN; PAM sequence: CTT
gggaactcttacaaactgac

SEQ ID NO: 33714 - DNA, 20 bp, Artificial Sequence
  Description of Artificial Sequence: Synthetic oligonucleotide
  Target: FXN; (+) strand; PAM type: YTN; PAM sequence: TTG
ggaactcttacaaactgacc

SEQ ID NO: 33715 - DNA, 20 bp, Artificial Sequence
  Description of Artificial Sequence: Synthetic oligonucleotide
  Target: FXN; (+) strand; PAM type: YTN; PAM sequence: CTC
ttacaaactgacctaccaac

SEQ ID NO: 33716 - DNA, 20 bp, Artificial Sequence
  Description of Artificial Sequence: Synthetic oligonucleotide
  Target: FXN; (+) strand; PAM type: YTN; PAM sequence: CTT
acaaactgacctaccaactt

SEQ ID NO: 33717 - DNA, 20 bp, Artificial Sequence
  Description of Artificial Sequence: Synthetic oligonucleotide
  Target: FXN; (+) strand; PAM type: YTN; PAM sequence: TTA
caaactgacctaccaacttg

SEQ ID NO: 33718 - DNA, 20 bp, Artificial Sequence
  Description of Artificial Sequence: Synthetic oligonucleotide
  Target: FXN; (+) strand; PAM type: YTN; PAM sequence: CTG
acctaccaacttgagcatcc

SEQ ID NO: 33719 - DNA, 20 bp, Artificial Sequence
  Description of Artificial Sequence: Synthetic oligonucleotide
  Target: FXN; (+) strand; PAM type: YTN; PAM sequence: CTA
ccaacttgagcatccacagc

SEQ ID NO: 33720 - DNA, 20 bp, Artificial Sequence
  Description of Artificial Sequence: Synthetic oligonucleotide
  Target: FXN; (+) strand; PAM type: YTN; PAM sequence: CTT
gagcatccacagcctgatca

SEQ ID NO: 33721 - DNA, 20 bp, Artificial Sequence
  Description of Artificial Sequence: Synthetic oligonucleotide
  Target: FXN; (+) strand; PAM type: YTN; PAM sequence: TTG
agcatccacagcctgatcag

SEQ ID NO: 33722 - DNA, 20 bp, Artificial Sequence
  Description of Artificial Sequence: Synthetic oligonucleotide
  Target: FXN; (+) strand; PAM type: YTN; PAM sequence: CTG
atcagaggtgggggagttaa

SEQ ID NO: 33723 - DNA, 20 bp, Artificial Sequence
  Description of Artificial Sequence: Synthetic oligonucleotide
  Target: FXN; (+) strand; PAM type: YTN; PAM sequence: TTA
agggccttctctcccctagc

SEQ ID NO: 33724 - DNA, 20 bp, Artificial Sequence
  Description of Artificial Sequence: Synthetic oligonucleotide
  Target: FXN; (+) strand; PAM type: YTN; PAM sequence: CTT
ctctcccctagcctctacta

SEQ ID NO: 33725 - DNA, 20 bp, Artificial Sequence
  Description of Artificial Sequence: Synthetic oligonucleotide
  Target: FXN; (+) strand; PAM type: YTN; PAM sequence: TTC
tctcccctagcctctactag

SEQ ID NO: 33726 - DNA, 20 bp, Artificial Sequence
  Description of Artificial Sequence: Synthetic oligonucleotide
  Target: FXN; (+) strand; PAM type: YTN; PAM sequence: CTC
tcccctagcctctactagag

SEQ ID NO: 33727 - DNA, 20 bp, Artificial Sequence
  Description of Artificial Sequence: Synthetic oligonucleotide
  Target: FXN; (+) strand; PAM type: YTN; PAM sequence: CTC
ccctagcctctactagagcc

SEQ ID NO: 33728 - DNA, 20 bp, Artificial Sequence
  Description of Artificial Sequence: Synthetic oligonucleotide
  Target: FXN; (+) strand; PAM type: YTN; PAM sequence: CTA
gcctctactagagcctgtaa

SEQ ID NO: 33729 - DNA, 20 bp, Artificial Sequence
  Description of Artificial Sequence: Synthetic oligonucleotide
  Target: FXN; (+) strand; PAM type: YTN; PAM sequence: CTC
tactagagcctgtaactgca

SEQ ID NO: 33730 - DNA, 20 bp, Artificial Sequence
  Description of Artificial Sequence: Synthetic oligonucleotide
  Target: FXN; (+) strand; PAM type: YTN; PAM sequence: CTA
ctagagcctgtaactgcagg

SEQ ID NO: 33731 - DNA, 20 bp, Artificial Sequence
  Description of Artificial Sequence: Synthetic oligonucleotide
  Target: FXN; (+) strand; PAM type: YTN; PAM sequence: CTA
gagcctgtaactgcagggaa

SEQ ID NO: 33732 - DNA, 20 bp, Artificial Sequence
  Description of Artificial Sequence: Synthetic oligonucleotide
  Target: FXN; (+) strand; PAM type: YTN; PAM sequence: CTG
taactgcagggaaaccaagt

SEQ ID NO: 33733 - DNA, 20 bp, Artificial Sequence
  Description of Artificial Sequence: Synthetic oligonucleotide
  Target: FXN; (+) strand; PAM type: YTN; PAM sequence: CTG
cagggaaaccaagttgcagg

SEQ ID NO: 33734 - DNA, 20 bp, Artificial Sequence
  Description of Artificial Sequence: Synthetic oligonucleotide
  Target: FXN; (+) strand; PAM type: YTN; PAM sequence: TTG
caggctaaactctgcccaca

SEQ ID NO: 33735 - DNA, 20 bp, Artificial Sequence
  Description of Artificial Sequence: Synthetic oligonucleotide
  Target: FXN; (+) strand; PAM type: YTN; PAM sequence: CTA
aactctgcccacacatgcag

SEQ ID NO: 33736 - DNA, 20 bp, Artificial Sequence
  Description of Artificial Sequence: Synthetic oligonucleotide
  Target: FXN; (+) strand; PAM type: YTN; PAM sequence: CTC
tgcccacacatgcagacatt

SEQ ID NO: 33737 - DNA, 20 bp, Artificial Sequence
  Description of Artificial Sequence: Synthetic oligonucleotide
  Target: FXN; (+) strand; PAM type: YTN; PAM sequence: CTG
cccacacatgcagacattga

SEQ ID NO: 33738 - DNA, 20 bp, Artificial Sequence
  Description of Artificial Sequence: Synthetic oligonucleotide
  Target: FXN; (+) strand; PAM type: YTN; PAM sequence: TTG
attagcaagctacaaaaaca

SEQ ID NO: 33739 - DNA, 20 bp, Artificial Sequence
  Description of Artificial Sequence: Synthetic oligonucleotide
  Target: FXN; (+) strand; PAM type: YTN; PAM sequence: TTA
gcaagctacaaaaacagtca

SEQ ID NO: 33740 - DNA, 20 bp, Artificial Sequence
  Description of Artificial Sequence: Synthetic oligonucleotide
  Target: FXN; (+) strand; PAM type: YTN; PAM sequence: CTA
caaaaacagtcatgaaacct

SEQ ID NO: 33741 - DNA, 20 bp, Artificial Sequence
  Description of Artificial Sequence: Synthetic oligonucleotide
  Target: FXN; (+) strand; PAM type: YTN; PAM sequence: CTG
tttttataggattagtgaag

SEQ ID NO: 33742 - DNA, 20 bp, Artificial Sequence
  Description of Artificial Sequence: Synthetic oligonucleotide
  Target: FXN; (+) strand; PAM type: YTN; PAM sequence: TTT
ttataggattagtgaagccc

SEQ ID NO: 33743 - DNA, 20 bp, Artificial Sequence
  Description of Artificial Sequence: Synthetic oligonucleotide
  Target: FXN; (+) strand; PAM type: YTN; PAM sequence: TTT
tataggattagtgaagcccc

SEQ ID NO: 33744 - DNA, 20 bp, Artificial Sequence
  Description of Artificial Sequence: Synthetic oligonucleotide
  Target: FXN; (+) strand; PAM type: YTN; PAM sequence: TTT
ataggattagtgaagcccca

SEQ ID NO: 33745 - DNA, 20 bp, Artificial Sequence
  Description of Artificial Sequence: Synthetic oligonucleotide
  Target: FXN; (+) strand; PAM type: YTN; PAM sequence: TTA
taggattagtgaagccccag

SEQ ID NO: 33746 - DNA, 20 bp, Artificial Sequence
  Description of Artificial Sequence: Synthetic oligonucleotide
  Target: FXN; (+) strand; PAM type: YTN; PAM sequence: TTA
gtgaagccccagtttgacca

SEQ ID NO: 33747 - DNA, 20 bp, Artificial Sequence
  Description of Artificial Sequence: Synthetic oligonucleotide
  Target: FXN; (+) strand; PAM type: YTN; PAM sequence: TTT
gaccagagtactttgcatga

SEQ ID NO: 33748 - DNA, 20 bp, Artificial Sequence
  Description of Artificial Sequence: Synthetic oligonucleotide
  Target: FXN; (+) strand; PAM type: YTN; PAM sequence: TTG
accagagtactttgcatgaa

SEQ ID NO: 33749 - DNA, 20 bp, Artificial Sequence
  Description of Artificial Sequence: Synthetic oligonucleotide
  Target: FXN; (+) strand; PAM type: YTN; PAM sequence: CTT
tgcatgaatgttttgttaga

SEQ ID NO: 33750 - DNA, 20 bp, Artificial Sequence
  Description of Artificial Sequence: Synthetic oligonucleotide
  Target: FXN; (+) strand; PAM type: YTN; PAM sequence: TTT
gcatgaatgttttgttagaa

SEQ ID NO: 33751 - DNA, 20 bp, Artificial Sequence
  Description of Artificial Sequence: Synthetic oligonucleotide
  Target: FXN; (+) strand; PAM type: YTN; PAM sequence: TTG
catgaatgttttgttagaag

SEQ ID NO: 33752 - DNA, 20 bp, Artificial Sequence
  Description of Artificial Sequence: Synthetic oligonucleotide
  Target: FXN; (+) strand; PAM type: YTN; PAM sequence: TTT
tgttagaagcaaatgtgcca

SEQ ID NO: 33753 - DNA, 20 bp, Artificial Sequence
  Description of Artificial Sequence: Synthetic oligonucleotide
  Target: FXN; (+) strand; PAM type: YTN; PAM sequence: TTT
gttagaagcaaatgtgccaa

SEQ ID NO: 33754 - DNA, 20 bp, Artificial Sequence
  Description of Artificial Sequence: Synthetic oligonucleotide
  Target: FXN; (+) strand; PAM type: YTN; PAM sequence: TTG
ttagaagcaaatgtgccaat

SEQ ID NO: 33755 - DNA, 20 bp, Artificial Sequence
  Description of Artificial Sequence: Synthetic oligonucleotide
  Target: FXN; (+) strand; PAM type: YTN; PAM sequence: TTA
gaagcaaatgtgccaatatt

SEQ ID NO: 33756 - DNA, 20 bp, Artificial Sequence
  Description of Artificial Sequence: Synthetic oligonucleotide
  Target: FXN; (+) strand; PAM type: YTN; PAM sequence: TTC
tagcagctgcgtttggttta

SEQ ID NO: 33757 - DNA, 20 bp, Artificial Sequence
  Description of Artificial Sequence: Synthetic oligonucleotide
  Target: FXN; (+) strand; PAM type: YTN; PAM sequence: CTA
gcagctgcgtttggtttact

SEQ ID NO: 33758 - DNA, 20 bp, Artificial Sequence
  Description of Artificial Sequence: Synthetic oligonucleotide
  Target: FXN; (+) strand; PAM type: YTN; PAM sequence: CTG
cgtttggtttacttcttctt

SEQ ID NO: 33759 - DNA, 20 bp, Artificial Sequence
  Description of Artificial Sequence: Synthetic oligonucleotide
  Target: FXN; (+) strand; PAM type: YTN; PAM sequence: TTT
ggtttacttcttcttcttct

SEQ ID NO: 33760 - DNA, 20 bp, Artificial Sequence
  Description of Artificial Sequence: Synthetic oligonucleotide
  Target: FXN; (+) strand; PAM type: YTN; PAM sequence: TTG
gtttacttcttcttcttctt

SEQ ID NO: 33761 - DNA, 20 bp, Artificial Sequence
  Description of Artificial Sequence: Synthetic oligonucleotide
  Target: FXN; (+) strand; PAM type: YTN; PAM sequence: TTT
acttcttcttcttctttttt

SEQ ID NO: 33762 - DNA, 20 bp, Artificial Sequence
  Description of Artificial Sequence: Synthetic oligonucleotide
  Target: FXN; (+) strand; PAM type: YTN; PAM sequence: TTA
cttcttcttcttcttttttt

SEQ ID NO: 33763 - DNA, 20 bp, Artificial Sequence
  Description of Artificial Sequence: Synthetic oligonucleotide
  Target: FXN; (+) strand; PAM type: YTN; PAM sequence: CTT
cttcttcttctttttttttt

SEQ ID NO: 33764 - DNA, 20 bp, Artificial Sequence
  Description of Artificial Sequence: Synthetic oligonucleotide
  Target: FXN; (+) strand; PAM type: YTN; PAM sequence: TTC
ttcttcttcttttttttttt

SEQ ID NO: 33765 - DNA, 20 bp, Artificial Sequence
  Description of Artificial Sequence: Synthetic oligonucleotide
  Target: FXN; (+) strand; PAM type: YTN; PAM sequence: CTT
cttcttcttttttttttttt

SEQ ID NO: 33766 - DNA, 20 bp, Artificial Sequence
  Description of Artificial Sequence: Synthetic oligonucleotide
  Target: FXN; (+) strand; PAM type: YTN; PAM sequence: TTC
ttcttctttttttttttttt

SEQ ID NO: 33767 - DNA, 20 bp, Artificial Sequence
  Description of Artificial Sequence: Synthetic oligonucleotide
  Target: FXN; (+) strand; PAM type: YTN; PAM sequence: CTT
cttctttttttttttttttg

SEQ ID NO: 33768 - DNA, 20 bp, Artificial Sequence
  Description of Artificial Sequence: Synthetic oligonucleotide
  Target: FXN; (+) strand; PAM type: YTN; PAM sequence: TTC
ttctttttttttttttttga

SEQ ID NO: 33769 - DNA, 20 bp, Artificial Sequence
  Description of Artificial Sequence: Synthetic oligonucleotide
  Target: FXN; (+) strand; PAM type: YTN; PAM sequence: CTT
ctttttttttttttttgagt

SEQ ID NO: 33770 - DNA, 20 bp, Artificial Sequence
  Description of Artificial Sequence: Synthetic oligonucleotide
  Target: FXN; (+) strand; PAM type: YTN; PAM sequence: TTC
tttttttttttttttgagtt

SEQ ID NO: 33771 - DNA, 20 bp, Artificial Sequence
  Description of Artificial Sequence: Synthetic oligonucleotide
  Target: FXN; (+) strand; PAM type: YTN; PAM sequence: CTT
tttttttttttttgagttga

SEQ ID NO: 33772 - DNA, 20 bp, Artificial Sequence
  Description of Artificial Sequence: Synthetic oligonucleotide
  Target: FXN; (+) strand; PAM type: YTN; PAM sequence: TTT
ttttttttttttgagttgaa

SEQ ID NO: 33773 - DNA, 20 bp, Artificial Sequence
  Description of Artificial Sequence: Synthetic oligonucleotide
  Target: FXN; (+) strand; PAM type: YTN; PAM sequence: TTT
tttttttttttgagttgaag

SEQ ID NO: 33774 - DNA, 20 bp, Artificial Sequence
  Description of Artificial Sequence: Synthetic oligonucleotide
  Target: FXN; (+) strand; PAM type: YTN; PAM sequence: TTT
ttttttttttgagttgaagc

SEQ ID NO: 33775 - DNA, 20 bp, Artificial Sequence
  Description of Artificial Sequence: Synthetic oligonucleotide
  Target: FXN; (+) strand; PAM type: YTN; PAM sequence: TTT
tttttttttgagttgaagcc

SEQ ID NO: 33776 - DNA, 20 bp, Artificial Sequence
  Description of Artificial Sequence: Synthetic oligonucleotide
  Target: FXN; (+) strand; PAM type: YTN; PAM sequence: TTT
ttttttttgagttgaagcct

SEQ ID NO: 33777 - DNA, 20 bp, Artificial Sequence
  Description of Artificial Sequence: Synthetic oligonucleotide
  Target: FXN; (+) strand; PAM type: YTN; PAM sequence: TTT
tttttttgagttgaagccta

SEQ ID NO: 33778 - DNA, 20 bp, Artificial Sequence
  Description of Artificial Sequence: Synthetic oligonucleotide
  Target: FXN; (+) strand; PAM type: YTN; PAM sequence: TTT
ttttttgagttgaagcctag

SEQ ID NO: 33779 - DNA, 20 bp, Artificial Sequence
  Description of Artificial Sequence: Synthetic oligonucleotide
  Target: FXN; (+) strand; PAM type: YTN; PAM sequence: TTT
tttttgagttgaagcctagc

SEQ ID NO: 33780 - DNA, 20 bp, Artificial Sequence
  Description of Artificial Sequence: Synthetic oligonucleotide
  Target: FXN; (+) strand; PAM type: YTN; PAM sequence: TTT
ttttgagttgaagcctagct

SEQ ID NO: 33781 - DNA, 20 bp, Artificial Sequence
  Description of Artificial Sequence: Synthetic oligonucleotide
  Target: FXN; (+) strand; PAM type: YTN; PAM sequence: TTT
tttgagttgaagcctagctc

SEQ ID NO: 33782 - DNA, 20 bp, Artificial Sequence
  Description of Artificial Sequence: Synthetic oligonucleotide
  Target: FXN; (+) strand; PAM type: YTN; PAM sequence: TTT
ttgagttgaagcctagctct

SEQ ID NO: 33783 - DNA, 20 bp, Artificial Sequence
  Description of Artificial Sequence: Synthetic oligonucleotide
  Target: FXN; (+) strand; PAM type: YTN; PAM sequence: TTT
tgagttgaagcctagctctg

SEQ ID NO: 33784 - DNA, 20 bp, Artificial Sequence
  Description of Artificial Sequence: Synthetic oligonucleotide
  Target: FXN; (+) strand; PAM type: YTN; PAM sequence: TTT
gagttgaagcctagctctgt

SEQ ID NO: 33785 - DNA, 20 bp, Artificial Sequence
  Description of Artificial Sequence: Synthetic oligonucleotide
  Target: FXN; (+) strand; PAM type: YTN; PAM sequence: TTG
agttgaagcctagctctgtc

SEQ ID NO: 33786 - DNA, 20 bp, Artificial Sequence
  Description of Artificial Sequence: Synthetic oligonucleotide
  Target: FXN; (+) strand; PAM type: YTN; PAM sequence: TTG
aagcctagctctgtcaccca

SEQ ID NO: 33787 - DNA, 20 bp, Artificial Sequence
  Description of Artificial Sequence: Synthetic oligonucleotide
  Target: FXN; (+) strand; PAM type: YTN; PAM sequence: CTA
gctctgtcacccaggctgga

SEQ ID NO: 33788 - DNA, 20 bp, Artificial Sequence
  Description of Artificial Sequence: Synthetic oligonucleotide
  Target: FXN; (+) strand; PAM type: YTN; PAM sequence: CTC
tgtcacccaggctggagtgc

SEQ ID NO: 33789 - DNA, 20 bp, Artificial Sequence
  Description of Artificial Sequence: Synthetic oligonucleotide
  Target: FXN; (+) strand; PAM type: YTN; PAM sequence: CTG
tcacccaggctggagtgcag

SEQ ID NO: 33790 - DNA, 20 bp, Artificial Sequence
  Description of Artificial Sequence: Synthetic oligonucleotide
  Target: FXN; (+) strand; PAM type: YTN; PAM sequence: CTG
gagtgcagttgtgtgatctc

SEQ ID NO: 33791 - DNA, 20 bp, Artificial Sequence
  Description of Artificial Sequence: Synthetic oligonucleotide
  Target: FXN; (+) strand; PAM type: YTN; PAM sequence: TTG
tgtgatctcagctcactgca

SEQ ID NO: 33792 - DNA, 20 bp, Artificial Sequence
  Description of Artificial Sequence: Synthetic oligonucleotide
  Target: FXN; (+) strand; PAM type: YTN; PAM sequence: CTC
agctcactgcaacctctgcc

SEQ ID NO: 33793 - DNA, 20 bp, Artificial Sequence
  Description of Artificial Sequence: Synthetic oligonucleotide
  Target: FXN; (+) strand; PAM type: YTN; PAM sequence: CTC
actgcaacctctgcctccca

SEQ ID NO: 33794 - DNA, 20 bp, Artificial Sequence
  Description of Artificial Sequence: Synthetic oligonucleotide
  Target: FXN; (+) strand; PAM type: YTN; PAM sequence: CTG
caacctctgcctcccaggtt

SEQ ID NO: 33795 - DNA, 20 bp, Artificial Sequence
  Description of Artificial Sequence: Synthetic oligonucleotide
  Target: FXN; (+) strand; PAM type: YTN; PAM sequence: CTC
tgcctcccaggttcaagcga

SEQ ID NO: 33796 - DNA, 20 bp, Artificial Sequence
  Description of Artificial Sequence: Synthetic oligonucleotide
  Target: FXN; (+) strand; PAM type: YTN; PAM sequence: CTG
cctcccaggttcaagcgatt

SEQ ID NO: 33797 - DNA, 20 bp, Artificial Sequence
  Description of Artificial Sequence: Synthetic oligonucleotide
  Target: FXN; (+) strand; PAM type: YTN; PAM sequence: CTC
ccaggttcaagcgattctcc

SEQ ID NO: 33798 - DNA, 20 bp, Artificial Sequence
  Description of Artificial Sequence: Synthetic oligonucleotide
  Target: FXN; (+) strand; PAM type: YTN; PAM sequence: TTC
aagcgattctcccgcctcaa

SEQ ID NO: 33799 - DNA, 20 bp, Artificial Sequence
  Description of Artificial Sequence: Synthetic oligonucleotide
  Target: FXN; (+) strand; PAM type: YTN; PAM sequence: TTC
tcccgcctcaacctcctgag

SEQ ID NO: 33800 - DNA, 20 bp, Artificial Sequence
  Description of Artificial Sequence: Synthetic oligonucleotide
  Target: FXN; (+) strand; PAM type: YTN; PAM sequence: CTC
ccgcctcaacctcctgagta

SEQ ID NO: 33801 - DNA, 20 bp, Artificial Sequence
  Description of Artificial Sequence: Synthetic oligonucleotide
  Target: FXN; (+) strand; PAM type: YTN; PAM sequence: CTC
aacctcctgagtagctggga

SEQ ID NO: 33802 - DNA, 20 bp, Artificial Sequence
  Description of Artificial Sequence: Synthetic oligonucleotide
  Target: FXN; (+) strand; PAM type: YTN; PAM sequence: CTC
ctgagtagctgggattacag

SEQ ID NO: 33803 - DNA, 20 bp, Artificial Sequence
  Description of Artificial Sequence: Synthetic oligonucleotide
  Target: FXN; (+) strand; PAM type: YTN; PAM sequence: CTG
agtagctgggattacagaca

SEQ ID NO: 33804 - DNA, 20 bp, Artificial Sequence
  Description of Artificial Sequence: Synthetic oligonucleotide
  Target: FXN; (+) strand; PAM type: YTN; PAM sequence: CTG
ggattacagacatgtaccac

SEQ ID NO: 33805 - DNA, 20 bp, Artificial Sequence
  Description of Artificial Sequence: Synthetic oligonucleotide
  Target: FXN; (+) strand; PAM type: YTN; PAM sequence: TTA
cagacatgtaccacaataca

SEQ ID NO: 33806 - DNA, 20 bp, Artificial Sequence
  Description of Artificial Sequence: Synthetic oligonucleotide
  Target: FXN; (+) strand; PAM type: YTN; PAM sequence: CTA
agttttgtatttttagtaga

SEQ ID NO: 33807 - DNA, 20 bp, Artificial Sequence
  Description of Artificial Sequence: Synthetic oligonucleotide
  Target: FXN; (+) strand; PAM type: YTN; PAM sequence: TTT
tgtatttttagtagaaatgg

SEQ ID NO: 33808 - DNA, 20 bp, Artificial Sequence
  Description of Artificial Sequence: Synthetic oligonucleotide
  Target: FXN; (+) strand; PAM type: YTN; PAM sequence: TTT
gtatttttagtagaaatggg

SEQ ID NO: 33809 - DNA, 20 bp, Artificial Sequence
  Description of Artificial Sequence: Synthetic oligonucleotide
  Target: FXN; (+) strand; PAM type: YTN; PAM sequence: TTG
tatttttagtagaaatgggg

SEQ ID NO: 33810 - DNA, 20 bp, Artificial Sequence
  Description of Artificial Sequence: Synthetic oligonucleotide
  Target: FXN; (+) strand; PAM type: YTN; PAM sequence: TTT
ttagtagaaatggggtttca

SEQ ID NO: 33811 - DNA, 20 bp, Artificial Sequence
  Description of Artificial Sequence: Synthetic oligonucleotide
  Target: FXN; (+) strand; PAM type: YTN; PAM sequence: TTT
tagtagaaatggggtttcac

SEQ ID NO: 33812 - DNA, 20 bp, Artificial Sequence
  Description of Artificial Sequence: Synthetic oligonucleotide
  Target: FXN; (+) strand; PAM type: YTN; PAM sequence: TTT
agtagaaatggggtttcacc

SEQ ID NO: 33813 - DNA, 20 bp, Artificial Sequence
  Description of Artificial Sequence: Synthetic oligonucleotide
  Target: FXN; (+) strand; PAM type: YTN; PAM sequence: TTA
gtagaaatggggtttcacca

SEQ ID NO: 33814 - DNA, 20 bp, Artificial Sequence
  Description of Artificial Sequence: Synthetic oligonucleotide
  Target: FXN; (+) strand; PAM type: YTN; PAM sequence: TTT
caccatgttggccaggctgg

SEQ ID NO: 33815 - DNA, 20 bp, Artificial Sequence
  Description of Artificial Sequence: Synthetic oligonucleotide
  Target: FXN; (+) strand; PAM type: YTN; PAM sequence: TTC
accatgttggccaggctggt

SEQ ID NO: 33816 - DNA, 20 bp, Artificial Sequence
  Description of Artificial Sequence: Synthetic oligonucleotide
  Target: FXN; (+) strand; PAM type: YTN; PAM sequence: TTG
gccaggctggtctcaaactc

SEQ ID NO: 33817 - DNA, 20 bp, Artificial Sequence
  Description of Artificial Sequence: Synthetic oligonucleotide
  Target: FXN; (+) strand; PAM type: YTN; PAM sequence: CTG
gtctcaaactcctgatctca

SEQ ID NO: 33818 - DNA, 20 bp, Artificial Sequence
  Description of Artificial Sequence: Synthetic oligonucleotide
  Target: FXN; (+) strand; PAM type: YTN; PAM sequence: CTC
aaactcctgatctcaagtga

SEQ ID NO: 33819 - DNA, 20 bp, Artificial Sequence
  Description of Artificial Sequence: Synthetic oligonucleotide
  Target: FXN; (+) strand; PAM type: YTN; PAM sequence: CTC
ctgatctcaagtgatccacc

SEQ ID NO: 33820 - DNA, 20 bp, Artificial Sequence
  Description of Artificial Sequence: Synthetic oligonucleotide
  Target: FXN; (+) strand; PAM type: YTN; PAM sequence: CTG
atctcaagtgatccacccgc

SEQ ID NO: 33821 - DNA, 20 bp, Artificial Sequence
  Description of Artificial Sequence: Synthetic oligonucleotide
  Target: FXN; (+) strand; PAM type: YTN; PAM sequence: CTC
aagtgatccacccgcctcag

SEQ ID NO: 33822 - DNA, 20 bp, Artificial Sequence
  Description of Artificial Sequence: Synthetic oligonucleotide
  Target: FXN; (+) strand; PAM type: YTN; PAM sequence: CTC
agcctcctaaagtgctgggt

SEQ ID NO: 33823 - DNA, 20 bp, Artificial Sequence
  Description of Artificial Sequence: Synthetic oligonucleotide
  Target: FXN; (+) strand; PAM type: YTN; PAM sequence: CTC
ctaaagtgctgggttaacag

SEQ ID NO: 33824 - DNA, 20 bp, Artificial Sequence
  Description of Artificial Sequence: Synthetic oligonucleotide
  Target: FXN; (+) strand; PAM type: YTN; PAM sequence: CTA
aagtgctgggttaacaggca

SEQ ID NO: 33825 - DNA, 20 bp, Artificial Sequence
  Description of Artificial Sequence: Synthetic oligonucleotide
  Target: FXN; (+) strand; PAM type: YTN; PAM sequence: CTG
ggttaacaggcatgagccac

SEQ ID NO: 33826 - DNA, 20 bp, Artificial Sequence
  Description of Artificial Sequence: Synthetic oligonucleotide
  Target: FXN; (+) strand; PAM type: YTN; PAM sequence: TTA
acaggcatgagccacggcac

SEQ ID NO: 33827 - DNA, 20 bp, Artificial Sequence
  Description of Artificial Sequence: Synthetic oligonucleotide
  Target: FXN; (+) strand; PAM type: YTN; PAM sequence: CTG
gcaaaagtcatcttttggtt

SEQ ID NO: 33828 - DNA, 20 bp, Artificial Sequence
  Description of Artificial Sequence: Synthetic oligonucleotide
  Target: FXN; (+) strand; PAM type: YTN; PAM sequence: CTT
ttggtttacttctattgaac

SEQ ID NO: 33829 - DNA, 20 bp, Artificial Sequence
  Description of Artificial Sequence: Synthetic oligonucleotide
  Target: FXN; (+) strand; PAM type: YTN; PAM sequence: TTT
tggtttacttctattgaact

SEQ ID NO: 33830 - DNA, 20 bp, Artificial Sequence
  Description of Artificial Sequence: Synthetic oligonucleotide
  Target: FXN; (+) strand; PAM type: YTN; PAM sequence: TTT
ggtttacttctattgaactg

SEQ ID NO: 33831 - DNA, 20 bp, Artificial Sequence
  Description of Artificial Sequence: Synthetic oligonucleotide
  Target: FXN; (+) strand; PAM type: YTN; PAM sequence: TTG
gtttacttctattgaactga

SEQ ID NO: 33832 - DNA, 20 bp, Artificial Sequence
  Description of Artificial Sequence: Synthetic oligonucleotide
  Target: FXN; (+) strand; PAM type: YTN; PAM sequence: TTT
acttctattgaactgaaaaa

SEQ ID NO: 33833 - DNA, 20 bp, Artificial Sequence
  Description of Artificial Sequence: Synthetic oligonucleotide
  Target: FXN; (+) strand; PAM type: YTN; PAM sequence: TTA
cttctattgaactgaaaaag

SEQ ID NO: 33834 - DNA, 20 bp, Artificial Sequence
  Description of Artificial Sequence: Synthetic oligonucleotide
  Target: FXN; (+) strand; PAM type: YTN; PAM sequence: CTT
ctattgaactgaaaaagtca

SEQ ID NO: 33835 - DNA, 20 bp, Artificial Sequence
  Description of Artificial Sequence: Synthetic oligonucleotide
  Target: FXN; (+) strand; PAM type: YTN; PAM sequence: TTC
tattgaactgaaaaagtcac

SEQ ID NO: 33836 - DNA, 20 bp, Artificial Sequence
  Description of Artificial Sequence: Synthetic oligonucleotide
  Target: FXN; (+) strand; PAM type: YTN; PAM sequence: CTA
ttgaactgaaaaagtcacaa

SEQ ID NO: 33837 - DNA, 20 bp, Artificial Sequence
  Description of Artificial Sequence: Synthetic oligonucleotide
  Target: FXN; (+) strand; PAM type: YTN; PAM sequence: TTG
aactgaaaaagtcacaaata

SEQ ID NO: 33838 - DNA, 20 bp, Artificial Sequence
  Description of Artificial Sequence: Synthetic oligonucleotide
  Target: FXN; (+) strand; PAM type: YTN; PAM sequence: CTG
aaaaagtcacaaatatattt

SEQ ID NO: 33839 - DNA, 20 bp, Artificial Sequence
  Description of Artificial Sequence: Synthetic oligonucleotide
  Target: FXN; (+) strand; PAM type: YTN; PAM sequence: TTT
atatttaattaaatatattt

SEQ ID NO: 33840 - DNA, 20 bp, Artificial Sequence
  Description of Artificial Sequence: Synthetic oligonucleotide
  Target: FXN; (+) strand; PAM type: YTN; PAM sequence: TTA
tatttaattaaatatattta

SEQ ID NO: 33841 - DNA, 20 bp, Artificial Sequence
  Description of Artificial Sequence: Synthetic oligonucleotide
  Target: FXN; (+) strand; PAM type: YTN; PAM sequence: TTT
aattaaatatatttatataa

SEQ ID NO: 33842 - DNA, 20 bp, Artificial Sequence
  Description of Artificial Sequence: Synthetic oligonucleotide
  Target: FXN; (+) strand; PAM type: YTN; PAM sequence: TTA
attaaatatatttatataaa

SEQ ID NO: 33843 - DNA, 20 bp, Artificial Sequence
  Description of Artificial Sequence: Synthetic oligonucleotide
  Target: FXN; (+) strand; PAM type: YTN; PAM sequence: TTA
aatatatttatataaaaata

SEQ ID NO: 33844 - DNA, 20 bp, Artificial Sequence
  Description of Artificial Sequence: Synthetic oligonucleotide
  Target: FXN; (+) strand; PAM type: YTN; PAM sequence: TTT
atataaaaatatggtattta

SEQ ID NO: 33845 - DNA, 20 bp, Artificial Sequence
  Description of Artificial Sequence: Synthetic oligonucleotide
  Target: FXN; (+) strand; PAM type: YTN; PAM sequence: TTA
tataaaaatatggtatttag

SEQ ID NO: 33846 - DNA, 20 bp, Artificial Sequence
  Description of Artificial Sequence: Synthetic oligonucleotide
  Target: FXN; (+) strand; PAM type: YTN; PAM sequence: TTT
agtattattatttttagaga

SEQ ID NO: 33847 - DNA, 20 bp, Artificial Sequence
  Description of Artificial Sequence: Synthetic oligonucleotide
  Target: FXN; (+) strand; PAM type: YTN; PAM sequence: TTA
gtattattatttttagagac

SEQ ID NO: 33848 - DNA, 20 bp, Artificial Sequence
  Description of Artificial Sequence: Synthetic oligonucleotide
  Target: FXN; (+) strand; PAM type: YTN; PAM sequence: TTA
ttatttttagagacagggcc

SEQ ID NO: 33849 - DNA, 20 bp, Artificial Sequence
  Description of Artificial Sequence: Synthetic oligonucleotide
  Target: FXN; (+) strand; PAM type: YTN; PAM sequence: TTA
tttttagagacagggcctcg

SEQ ID NO: 33850 - DNA, 20 bp, Artificial Sequence
  Description of Artificial Sequence: Synthetic oligonucleotide
  Target: FXN; (+) strand; PAM type: YTN; PAM sequence: TTT
ttagagacagggcctcgctc

SEQ ID NO: 33851 - DNA, 20 bp, Artificial Sequence
  Description of Artificial Sequence: Synthetic oligonucleotide
  Target: FXN; (+) strand; PAM type: YTN; PAM sequence: TTT
tagagacagggcctcgctct

SEQ ID NO: 33852 - DNA, 20 bp, Artificial Sequence
  Description of Artificial Sequence: Synthetic oligonucleotide
  Target: FXN; (+) strand; PAM type: YTN; PAM sequence: TTT
agagacagggcctcgctctg

SEQ ID NO: 33853 - DNA, 20 bp, Artificial Sequence
  Description of Artificial Sequence: Synthetic oligonucleotide
  Target: FXN; (+) strand; PAM type: YTN; PAM sequence: TTA
gagacagggcctcgctctgt

SEQ ID NO: 33854 - DNA, 20 bp, Artificial Sequence
  Description of Artificial Sequence: Synthetic oligonucleotide
  Target: FXN; (+) strand; PAM type: YTN; PAM sequence: CTC
gctctgtcacccaggctgga

SEQ ID NO: 33855 - DNA, 20 bp, Artificial Sequence
  Description of Artificial Sequence: Synthetic oligonucleotide
  Target: FXN; (+) strand; PAM type: YTN; PAM sequence: CTC
tgtcacccaggctggagtgc

SEQ ID NO: 33856 - DNA, 20 bp, Artificial Sequence
  Description of Artificial Sequence: Synthetic oligonucleotide
  Target: FXN; (+) strand; PAM type: YTN; PAM sequence: CTG
tcacccaggctggagtgcag

SEQ ID NO: 33857 - DNA, 20 bp, Artificial Sequence
  Description of Artificial Sequence: Synthetic oligonucleotide
  Target: FXN; (+) strand; PAM type: YTN; PAM sequence: CTG
gagtgcagtggcacaatcat

SEQ ID NO: 33858 - DNA, 20 bp, Artificial Sequence
  Description of Artificial Sequence: Synthetic oligonucleotide
  Target: FXN; (+) strand; PAM type: YTN; PAM sequence: CTC
actgcagcctcaagcttctg

SEQ ID NO: 33859 - DNA, 20 bp, Artificial Sequence
  Description of Artificial Sequence: Synthetic oligonucleotide
  Target: FXN; (+) strand; PAM type: YTN; PAM sequence: CTG
cagcctcaagcttctgggct

SEQ ID NO: 33860 - DNA, 20 bp, Artificial Sequence
  Description of Artificial Sequence: Synthetic oligonucleotide
  Target: FXN; (+) strand; PAM type: YTN; PAM sequence: CTC
aagcttctgggctcaagtga

SEQ ID NO: 33861 - DNA, 20 bp, Artificial Sequence
  Description of Artificial Sequence: Synthetic oligonucleotide
  Target: FXN; (+) strand; PAM type: YTN; PAM sequence: CTT
ctgggctcaagtgatcgttc

SEQ ID NO: 33862 - DNA, 20 bp, Artificial Sequence
  Description of Artificial Sequence: Synthetic oligonucleotide
  Target: FXN; (+) strand; PAM type: YTN; PAM sequence: TTC
tgggctcaagtgatcgttcc

SEQ ID NO: 33863 - DNA, 20 bp, Artificial Sequence
  Description of Artificial Sequence: Synthetic oligonucleotide
  Target: FXN; (+) strand; PAM type: YTN; PAM sequence: CTG
ggctcaagtgatcgttccac

SEQ ID NO: 33864 - DNA, 20 bp, Artificial Sequence
  Description of Artificial Sequence: Synthetic oligonucleotide
  Target: FXN; (+) strand; PAM type: YTN; PAM sequence: CTC
aagtgatcgttccacctcag

SEQ ID NO: 33865 - DNA, 20 bp, Artificial Sequence
  Description of Artificial Sequence: Synthetic oligonucleotide
  Target: FXN; (+) strand; PAM type: YTN; PAM sequence: TTC
cacctcagcctccctagtag

SEQ ID NO: 33866 - DNA, 20 bp, Artificial Sequence
  Description of Artificial Sequence: Synthetic oligonucleotide
  Target: FXN; (+) strand; PAM type: YTN; PAM sequence: CTC
agcctccctagtagctggga

SEQ ID NO: 33867 - DNA, 20 bp, Artificial Sequence
  Description of Artificial Sequence: Synthetic oligonucleotide
  Target: FXN; (+) strand; PAM type: YTN; PAM sequence: CTC
cctagtagctgggactacag

SEQ ID NO: 33868 - DNA, 20 bp, Artificial Sequence
  Description of Artificial Sequence: Synthetic oligonucleotide
  Target: FXN; (+) strand; PAM type: YTN; PAM sequence: CTA
gtagctgggactacaggcac

SEQ ID NO: 33869 - DNA, 20 bp, Artificial Sequence
  Description of Artificial Sequence: Synthetic oligonucleotide
  Target: FXN; (+) strand; PAM type: YTN; PAM sequence: CTG
ggactacaggcacatgccac

SEQ ID NO: 33870 - DNA, 20 bp, Artificial Sequence
  Description of Artificial Sequence: Synthetic oligonucleotide
  Target: FXN; (+) strand; PAM type: YTN; PAM sequence: CTA
caggcacatgccaccatact

SEQ ID NO: 33871 - DNA, 20 bp, Artificial Sequence
  Description of Artificial Sequence: Synthetic oligonucleotide
  Target: FXN; (+) strand; PAM type: YTN; PAM sequence: CTC
ggctaattattttattttat

SEQ ID NO: 33872 - DNA, 20 bp, Artificial Sequence
  Description of Artificial Sequence: Synthetic oligonucleotide
  Target: FXN; (+) strand; PAM type: YTN; PAM sequence: CTA
attattttattttatttatg

SEQ ID NO: 33873 - DNA, 20 bp, Artificial Sequence
  Description of Artificial Sequence: Synthetic oligonucleotide
  Target: FXN; (+) strand; PAM type: YTN; PAM sequence: TTA
ttttattttatttatgggtc

SEQ ID NO: 33874 - DNA, 20 bp, Artificial Sequence
  Description of Artificial Sequence: Synthetic oligonucleotide
  Target: FXN; (+) strand; PAM type: YTN; PAM sequence: TTT
tattttatttatgggtctcg

SEQ ID NO: 33875 - DNA, 20 bp, Artificial Sequence
  Description of Artificial Sequence: Synthetic oligonucleotide
  Target: FXN; (+) strand; PAM type: YTN; PAM sequence: TTT
attttatttatgggtctcgc

SEQ ID NO: 33876 - DNA, 20 bp, Artificial Sequence
  Description of Artificial Sequence: Synthetic oligonucleotide
  Target: FXN; (+) strand; PAM type: YTN; PAM sequence: TTA
ttttatttatgggtctcgct

SEQ ID NO: 33877 - DNA, 20 bp, Artificial Sequence
  Description of Artificial Sequence: Synthetic oligonucleotide
  Target: FXN; (+) strand; PAM type: YTN; PAM sequence: TTT
tatttatgggtctcgctatg

SEQ ID NO: 33878 - DNA, 20 bp, Artificial Sequence
  Description of Artificial Sequence: Synthetic oligonucleotide
  Target: FXN; (+) strand; PAM type: YTN; PAM sequence: TTT
atttatgggtctcgctatgt

SEQ ID NO: 33879 - DNA, 20 bp, Artificial Sequence
  Description of Artificial Sequence: Synthetic oligonucleotide
  Target: FXN; (+) strand; PAM type: YTN; PAM sequence: TTA
tttatgggtctcgctatgtt

SEQ ID NO: 33880 - DNA, 20 bp, Artificial Sequence
  Description of Artificial Sequence: Synthetic oligonucleotide
  Target: FXN; (+) strand; PAM type: YTN; PAM sequence: TTT
atgggtctcgctatgtttcc

SEQ ID NO: 33881 - DNA, 20 bp, Artificial Sequence
  Description of Artificial Sequence: Synthetic oligonucleotide
  Target: FXN; (+) strand; PAM type: YTN; PAM sequence: TTA
tgggtctcgctatgtttccc

SEQ ID NO: 33882 - DNA, 20 bp, Artificial Sequence
  Description of Artificial Sequence: Synthetic oligonucleotide
  Target: FXN; (+) strand; PAM type: YTN; PAM sequence: CTC
gctatgtttcccaggctggt

SEQ ID NO: 33883 - DNA, 20 bp, Artificial Sequence
  Description of Artificial Sequence: Synthetic oligonucleotide
  Target: FXN; (+) strand; PAM type: YTN; PAM sequence: CTA
tgtttcccaggctggtctca

SEQ ID NO: 33884 - DNA, 20 bp, Artificial Sequence
  Description of Artificial Sequence: Synthetic oligonucleotide
  Target: FXN; (+) strand; PAM type: YTN; PAM sequence: TTT
cccaggctggtctcaaactc

SEQ ID NO: 33885 - DNA, 20 bp, Artificial Sequence
  Description of Artificial Sequence: Synthetic oligonucleotide
  Target: FXN; (+) strand; PAM type: YTN; PAM sequence: TTC
ccaggctggtctcaaactcc

SEQ ID NO: 33886 - DNA, 20 bp, Artificial Sequence
  Description of Artificial Sequence: Synthetic oligonucleotide
  Target: FXN; (+) strand; PAM type: YTN; PAM sequence: CTG
gtctcaaactcctggcctca

SEQ ID NO: 33887 - DNA, 20 bp, Artificial Sequence
  Description of Artificial Sequence: Synthetic oligonucleotide
  Target: FXN; (+) strand; PAM type: YTN; PAM sequence: CTC
aaactcctggcctcaagcga

SEQ ID NO: 33888 - DNA, 20 bp, Artificial Sequence
  Description of Artificial Sequence: Synthetic oligonucleotide
  Target: FXN; (+) strand; PAM type: YTN; PAM sequence: CTC
ctggcctcaagcgattctct

SEQ ID NO: 33889 - DNA, 20 bp, Artificial Sequence
  Description of Artificial Sequence: Synthetic oligonucleotide
  Target: FXN; (+) strand; PAM type: YTN; PAM sequence: CTG
gcctcaagcgattctctcac

SEQ ID NO: 33890 - DNA, 20 bp, Artificial Sequence
  Description of Artificial Sequence: Synthetic oligonucleotide
  Target: FXN; (+) strand; PAM type: YTN; PAM sequence: CTC
aagcgattctctcacctcgg

SEQ ID NO: 33891 - DNA, 20 bp, Artificial Sequence
  Description of Artificial Sequence: Synthetic oligonucleotide
  Target: FXN; (+) strand; PAM type: YTN; PAM sequence: TTC
tctcacctcggcctcccaaa

SEQ ID NO: 33892 - DNA, 20 bp, Artificial Sequence
  Description of Artificial Sequence: Synthetic oligonucleotide
  Target: FXN; (+) strand; PAM type: YTN; PAM sequence: CTC
tcacctcggcctcccaaagc

SEQ ID NO: 33893 - DNA, 20 bp, Artificial Sequence
  Description of Artificial Sequence: Synthetic oligonucleotide
  Target: FXN; (+) strand; PAM type: YTN; PAM sequence: CTC
acctcggcctcccaaagcac

SEQ ID NO: 33894 - DNA, 20 bp, Artificial Sequence
  Description of Artificial Sequence: Synthetic oligonucleotide
  Target: FXN; (+) strand; PAM type: YTN; PAM sequence: CTC
ggcctcccaaagcaccggga

SEQ ID NO: 33895 - DNA, 20 bp, Artificial Sequence
  Description of Artificial Sequence: Synthetic oligonucleotide
  Target: FXN; (+) strand; PAM type: YTN; PAM sequence: CTC
ccaaagcaccgggattacag

SEQ ID NO: 33896 - DNA, 20 bp, Artificial Sequence
  Description of Artificial Sequence: Synthetic oligonucleotide
  Target: FXN; (+) strand; PAM type: YTN; PAM sequence: TTA
caggtgtgtgccagcacacc

SEQ ID NO: 33897 - DNA, 20 bp, Artificial Sequence
  Description of Artificial Sequence: Synthetic oligonucleotide
  Target: FXN; (+) strand; PAM type: YTN; PAM sequence: CTA
taaatttagaaaggaggact

SEQ ID NO: 33898 - DNA, 20 bp, Artificial Sequence
  Description of Artificial Sequence: Synthetic oligonucleotide
  Target: FXN; (+) strand; PAM type: YTN; PAM sequence: TTT
agaaaggaggactatttcta

SEQ ID NO: 33899 - DNA, 20 bp, Artificial Sequence
  Description of Artificial Sequence: Synthetic oligonucleotide
  Target: FXN; (+) strand; PAM type: YTN; PAM sequence: TTA
gaaaggaggactatttctaa

SEQ ID NO: 33900 - DNA, 20 bp, Artificial Sequence
  Description of Artificial Sequence: Synthetic oligonucleotide
  Target: FXN; (+) strand; PAM type: YTN; PAM sequence: CTA
tttctaaagagggtcccact

SEQ ID NO: 33901 - DNA, 20 bp, Artificial Sequence
  Description of Artificial Sequence: Synthetic oligonucleotide
  Target: FXN; (+) strand; PAM type: YTN; PAM sequence: TTT
ctaaagagggtcccactacc

SEQ ID NO: 33902 - DNA, 20 bp, Artificial Sequence
  Description of Artificial Sequence: Synthetic oligonucleotide
  Target: FXN; (+) strand; PAM type: YTN; PAM sequence: TTC
taaagagggtcccactacct

SEQ ID NO: 33903 - DNA, 20 bp, Artificial Sequence
  Description of Artificial Sequence: Synthetic oligonucleotide
  Target: FXN; (+) strand; PAM type: YTN; PAM sequence: CTA
aagagggtcccactacctgt

SEQ ID NO: 33904 - DNA, 20 bp, Artificial Sequence
  Description of Artificial Sequence: Synthetic oligonucleotide
  Target: FXN; (+) strand; PAM type: YTN; PAM sequence: CTA
cctgtaggcaggaagcagag

SEQ ID NO: 33905 - DNA, 20 bp, Artificial Sequence
  Description of Artificial Sequence: Synthetic oligonucleotide
  Target: FXN; (+) strand; PAM type: YTN; PAM sequence: CTG
taggcaggaagcagagcctc

SEQ ID NO: 33906 - DNA, 20 bp, Artificial Sequence
  Description of Artificial Sequence: Synthetic oligonucleotide
  Target: FXN; (+) strand; PAM type: YTN; PAM sequence: CTC
tggccataactgaaaaacaa

SEQ ID NO: 33907 - DNA, 20 bp, Artificial Sequence
  Description of Artificial Sequence: Synthetic oligonucleotide
  Target: FXN; (+) strand; PAM type: YTN; PAM sequence: CTG
gccataactgaaaaacaagc

SEQ ID NO: 33908 - DNA, 20 bp, Artificial Sequence
  Description of Artificial Sequence: Synthetic oligonucleotide
  Target: FXN; (+) strand; PAM type: YTN; PAM sequence: CTG
aaaaacaagcacttccaaga

SEQ ID NO: 33909 - DNA, 20 bp, Artificial Sequence
  Description of Artificial Sequence: Synthetic oligonucleotide
  Target: FXN; (+) strand; PAM type: YTN; PAM sequence: CTT
ccaagaaggggcaaagggaa

SEQ ID NO: 33910 - DNA, 20 bp, Artificial Sequence
  Description of Artificial Sequence: Synthetic oligonucleotide
  Target: FXN; (+) strand; PAM type: YTN; PAM sequence: TTC
caagaaggggcaaagggaac

SEQ ID NO: 33911 - DNA, 20 bp, Artificial Sequence
  Description of Artificial Sequence: Synthetic oligonucleotide
  Target: FXN; (+) strand; PAM type: YTN; PAM sequence: TTT
atgctgagaggcgtagctaa

SEQ ID NO: 33912 - DNA, 20 bp, Artificial Sequence
  Description of Artificial Sequence: Synthetic oligonucleotide
  Target: FXN; (+) strand; PAM type: YTN; PAM sequence: TTA
tgctgagaggcgtagctaag

SEQ ID NO: 33913 - DNA, 20 bp, Artificial Sequence
  Description of Artificial Sequence: Synthetic oligonucleotide
  Target: FXN; (+) strand; PAM type: YTN; PAM sequence: CTG
agaggcgtagctaagcatac

SEQ ID NO: 33914 - DNA, 20 bp, Artificial Sequence
  Description of Artificial Sequence: Synthetic oligonucleotide
  Target: FXN; (+) strand; PAM type: YTN; PAM sequence: CTA
agcatacatattcaacagat

SEQ ID NO: 33915 - DNA, 20 bp, Artificial Sequence
  Description of Artificial Sequence: Synthetic oligonucleotide
  Target: FXN; (+) strand; PAM type: YTN; PAM sequence: TTC
aacagattatgggaggatct

SEQ ID NO: 33916 - DNA, 20 bp, Artificial Sequence
  Description of Artificial Sequence: Synthetic oligonucleotide
  Target: FXN; (+) strand; PAM type: YTN; PAM sequence: TTA
tgggaggatctatgaatatt

SEQ ID NO: 33917 - DNA, 20 bp, Artificial Sequence
  Description of Artificial Sequence: Synthetic oligonucleotide
  Target: FXN; (+) strand; PAM type: YTN; PAM sequence: CTA
tgaatattcacaaagggagg

SEQ ID NO: 33918 - DNA, 20 bp, Artificial Sequence
  Description of Artificial Sequence: Synthetic oligonucleotide
  Target: FXN; (+) strand; PAM type: YTN; PAM sequence: TTC
acaaagggaggatctatgaa

SEQ ID NO: 33919 - DNA, 20 bp, Artificial Sequence
  Description of Artificial Sequence: Synthetic oligonucleotide
  Target: FXN; (+) strand; PAM type: YTN; PAM sequence: CTA
tgaatatgcacacatgtgga

SEQ ID NO: 33920 - DNA, 20 bp, Artificial Sequence
  Description of Artificial Sequence: Synthetic oligonucleotide
  Target: FXN; (+) strand; PAM type: YTN; PAM sequence: CTA
acgtgtgcagcatgtctccc

SEQ ID NO: 33921 - DNA, 20 bp, Artificial Sequence
  Description of Artificial Sequence: Synthetic oligonucleotide
  Target: FXN; (+) strand; PAM type: YTN; PAM sequence: CTC
ccatgttcaccttaggcaga

SEQ ID NO: 33922 - DNA, 20 bp, Artificial Sequence
  Description of Artificial Sequence: Synthetic oligonucleotide
  Target: FXN; (+) strand; PAM type: YTN; PAM sequence: TTC
accttaggcagaaacttaac

SEQ ID NO: 33923 - DNA, 20 bp, Artificial Sequence
  Description of Artificial Sequence: Synthetic oligonucleotide
  Target: FXN; (+) strand; PAM type: YTN; PAM sequence: CTT
aggcagaaacttaacactaa

SEQ ID NO: 33924 - DNA, 20 bp, Artificial Sequence
  Description of Artificial Sequence: Synthetic oligonucleotide
  Target: FXN; (+) strand; PAM type: YTN; PAM sequence: TTA
ggcagaaacttaacactaac

SEQ ID NO: 33925 - DNA, 20 bp, Artificial Sequence
  Description of Artificial Sequence: Synthetic oligonucleotide
  Target: FXN; (+) strand; PAM type: YTN; PAM sequence: CTT
aacactaacatgtattacag

SEQ ID NO: 33926 - DNA, 20 bp, Artificial Sequence
  Description of Artificial Sequence: Synthetic oligonucleotide
  Target: FXN; (+) strand; PAM type: YTN; PAM sequence: TTA
acactaacatgtattacagg

SEQ ID NO: 33927 - DNA, 20 bp, Artificial Sequence
  Description of Artificial Sequence: Synthetic oligonucleotide
  Target: FXN; (+) strand; PAM type: YTN; PAM sequence: CTA
acatgtattacagggcaaca

SEQ ID NO: 33928 - DNA, 20 bp, Artificial Sequence
  Description of Artificial Sequence: Synthetic oligonucleotide
  Target: FXN; (+) strand; PAM type: YTN; PAM sequence: TTA
cagggcaacaaaatgagact

SEQ ID NO: 33929 - DNA, 20 bp, Artificial Sequence
  Description of Artificial Sequence: Synthetic oligonucleotide
  Target: FXN; (+) strand; PAM type: YTN; PAM sequence: CTG
catatctacataacctagct

SEQ ID NO: 33930 - DNA, 20 bp, Artificial Sequence
  Description of Artificial Sequence: Synthetic oligonucleotide
  Target: FXN; (+) strand; PAM type: YTN; PAM sequence: CTA
cataacctagctatttggta

SEQ ID NO: 33931 - DNA, 20 bp, Artificial Sequence
  Description of Artificial Sequence: Synthetic oligonucleotide
  Target: FXN; (+) strand; PAM type: YTN; PAM sequence: CTA
gctatttggtaggctgaagc

SEQ ID NO: 33932 - DNA, 20 bp, Artificial Sequence
  Description of Artificial Sequence: Synthetic oligonucleotide
  Target: FXN; (+) strand; PAM type: YTN; PAM sequence: CTA
tttggtaggctgaagcagga

SEQ ID NO: 33933 - DNA, 20 bp, Artificial Sequence
  Description of Artificial Sequence: Synthetic oligonucleotide
  Target: FXN; (+) strand; PAM type: YTN; PAM sequence: TTT
ggtaggctgaagcaggagca

SEQ ID NO: 33934 - DNA, 20 bp, Artificial Sequence
  Description of Artificial Sequence: Synthetic oligonucleotide
  Target: FXN; (+) strand; PAM type: YTN; PAM sequence: TTG
gtaggctgaagcaggagcat

SEQ ID NO: 33935 - DNA, 20 bp, Artificial Sequence
  Description of Artificial Sequence: Synthetic oligonucleotide
  Target: FXN; (+) strand; PAM type: YTN; PAM sequence: CTG
aagcaggagcatcacttaag

SEQ ID NO: 33936 - DNA, 20 bp, Artificial Sequence
  Description of Artificial Sequence: Synthetic oligonucleotide
  Target: FXN; (+) strand; PAM type: YTN; PAM sequence: CTT
aagactgggagttcgaggca

SEQ ID NO: 33937 - DNA, 20 bp, Artificial Sequence
  Description of Artificial Sequence: Synthetic oligonucleotide
  Target: FXN; (+) strand; PAM type: YTN; PAM sequence: TTA
agactgggagttcgaggcag

SEQ ID NO: 33938 - DNA, 20 bp, Artificial Sequence
  Description of Artificial Sequence: Synthetic oligonucleotide
  Target: FXN; (+) strand; PAM type: YTN; PAM sequence: CTG
ggagttcgaggcagctgtga

SEQ ID NO: 33939 - DNA, 20 bp, Artificial Sequence
  Description of Artificial Sequence: Synthetic oligonucleotide
  Target: FXN; (+) strand; PAM type: YTN; PAM sequence: TTC
gaggcagctgtgagccatga

SEQ ID NO: 33940 - DNA, 20 bp, Artificial Sequence
  Description of Artificial Sequence: Synthetic oligonucleotide
  Target: FXN; (+) strand; PAM type: YTN; PAM sequence: CTG
tgagccatgatcgcaccact

SEQ ID NO: 33941 - DNA, 20 bp, Artificial Sequence
  Description of Artificial Sequence: Synthetic oligonucleotide
  Target: FXN; (+) strand; PAM type: YTN; PAM sequence: CTG
ttctccagccaggatgacag

SEQ ID NO: 33942 - DNA, 20 bp, Artificial Sequence
  Description of Artificial Sequence: Synthetic oligonucleotide
  Target: FXN; (+) strand; PAM type: YTN; PAM sequence: TTC
tccagccaggatgacagggc

SEQ ID NO: 33943 - DNA, 20 bp, Artificial Sequence
  Description of Artificial Sequence: Synthetic oligonucleotide
  Target: FXN; (+) strand; PAM type: YTN; PAM sequence: CTC
cagccaggatgacagggcaa

SEQ ID NO: 33944 - DNA, 20 bp, Artificial Sequence
  Description of Artificial Sequence: Synthetic oligonucleotide
  Target: FXN; (+) strand; PAM type: YTN; PAM sequence: CTG
tcttagaccactctgtggtc

SEQ ID NO: 33945 - DNA, 20 bp, Artificial Sequence
  Description of Artificial Sequence: Synthetic oligonucleotide
  Target: FXN; (+) strand; PAM type: YTN; PAM sequence: CTT
agaccactctgtggtcagtg

SEQ ID NO: 33946 - DNA, 20 bp, Artificial Sequence
  Description of Artificial Sequence: Synthetic oligonucleotide
  Target: FXN; (+) strand; PAM type: YTN; PAM sequence: TTA
gaccactctgtggtcagtgg

SEQ ID NO: 33947 - DNA, 20 bp, Artificial Sequence
  Description of Artificial Sequence: Synthetic oligonucleotide
  Target: FXN; (+) strand; PAM type: YTN; PAM sequence: CTC
tgtggtcagtggttatcagg

SEQ ID NO: 33948 - DNA, 20 bp, Artificial Sequence
  Description of Artificial Sequence: Synthetic oligonucleotide
  Target: FXN; (+) strand; PAM type: YTN; PAM sequence: CTG
tggtcagtggttatcaggaa

SEQ ID NO: 33949 - DNA, 20 bp, Artificial Sequence
  Description of Artificial Sequence: Synthetic oligonucleotide
  Target: FXN; (+) strand; PAM type: YTN; PAM sequence: TTA
tcaggaaggaatgctagtca

SEQ ID NO: 33950 - DNA, 20 bp, Artificial Sequence
  Description of Artificial Sequence: Synthetic oligonucleotide
  Target: FXN; (+) strand; PAM type: YTN; PAM sequence: CTA
gtcagttgtgctgaaaccac

SEQ ID NO: 33951 - DNA, 20 bp, Artificial Sequence
  Description of Artificial Sequence: Synthetic oligonucleotide
  Target: FXN; (+) strand; PAM type: YTN; PAM sequence: TTG
tgctgaaaccactaaaaagg

SEQ ID NO: 33952 - DNA, 20 bp, Artificial Sequence
  Description of Artificial Sequence: Synthetic oligonucleotide
  Target: FXN; (+) strand; PAM type: YTN; PAM sequence: CTG
aaaccactaaaaaggaaggg

SEQ ID NO: 33953 - DNA, 20 bp, Artificial Sequence
  Description of Artificial Sequence: Synthetic oligonucleotide
  Target: FXN; (+) strand; PAM type: YTN; PAM sequence: CTA
aaaaggaagggcagaattag

SEQ ID NO: 33954 - DNA, 20 bp, Artificial Sequence
  Description of Artificial Sequence: Synthetic oligonucleotide
  Target: FXN; (+) strand; PAM type: YTN; PAM sequence: TTA
ggtgatgagttgataccagt

SEQ ID NO: 33955 - DNA, 20 bp, Artificial Sequence
  Description of Artificial Sequence: Synthetic oligonucleotide
  Target: FXN; (+) strand; PAM type: YTN; PAM sequence: TTG
ataccagtggtgaagtgagt

SEQ ID NO: 33956 - DNA, 20 bp, Artificial Sequence
  Description of Artificial Sequence: Synthetic oligonucleotide
  Target: FXN; (+) strand; PAM type: YTN; PAM sequence: CTT
ttttttttttttctttttga

SEQ ID NO: 33957 - DNA, 20 bp, Artificial Sequence
  Description of Artificial Sequence: Synthetic oligonucleotide
  Target: FXN; (+) strand; PAM type: YTN; PAM sequence: TTT
tttttttttttctttttgag

SEQ ID NO: 33958 - DNA, 20 bp, Artificial Sequence
  Description of Artificial Sequence: Synthetic oligonucleotide
  Target: FXN; (+) strand; PAM type: YTN; PAM sequence: TTT
ttttttttttctttttgaga

SEQ ID NO: 33959 - DNA, 20 bp, Artificial Sequence
  Description of Artificial Sequence: Synthetic oligonucleotide
  Target: FXN; (+) strand; PAM type: YTN; PAM sequence: TTT
tttttttttctttttgagat

SEQ ID NO: 33960 - DNA, 20 bp, Artificial Sequence
  Description of Artificial Sequence: Synthetic oligonucleotide
  Target: FXN; (+) strand; PAM type: YTN; PAM sequence: TTT
ttttttttctttttgagatg

SEQ ID NO: 33961 - DNA, 20 bp, Artificial Sequence
  Description of Artificial Sequence: Synthetic oligonucleotide
  Target: FXN; (+) strand; PAM type: YTN; PAM sequence: TTT
tttttttctttttgagatgg

SEQ ID NO: 33962 - DNA, 20 bp, Artificial Sequence
  Description of Artificial Sequence: Synthetic oligonucleotide
  Target: FXN; (+) strand; PAM type: YTN; PAM sequence: TTT
ttttttctttttgagatgga

SEQ ID NO: 33963 - DNA, 20 bp, Artificial Sequence
  Description of Artificial Sequence: Synthetic oligonucleotide
  Target: FXN; (+) strand; PAM type: YTN; PAM sequence: TTT
tttttctttttgagatggag

SEQ ID NO: 33964 - DNA, 20 bp, Artificial Sequence
  Description of Artificial Sequence: Synthetic oligonucleotide
  Target: FXN; (+) strand; PAM type: YTN; PAM sequence: TTT
ttttctttttgagatggagt

SEQ ID NO: 33965 - DNA, 20 bp, Artificial Sequence
  Description of Artificial Sequence: Synthetic oligonucleotide
  Target: FXN; (+) strand; PAM type: YTN; PAM sequence: TTT
tttctttttgagatggagtc

SEQ ID NO: 33966 - DNA, 20 bp, Artificial Sequence
  Description of Artificial Sequence: Synthetic oligonucleotide
  Target: FXN; (+) strand; PAM type: YTN; PAM sequence: TTT
ttctttttgagatggagtct

SEQ ID NO: 33967 - DNA, 20 bp, Artificial Sequence
  Description of Artificial Sequence: Synthetic oligonucleotide
  Target: FXN; (+) strand; PAM type: YTN; PAM sequence: TTT
tctttttgagatggagtctt

SEQ ID NO: 33968 - DNA, 20 bp, Artificial Sequence
  Description of Artificial Sequence: Synthetic oligonucleotide
  Target: FXN; (+) strand; PAM type: YTN; PAM sequence: TTT
ctttttgagatggagtcttg

SEQ ID NO: 33969 - DNA, 20 bp, Artificial Sequence
  Description of Artificial Sequence: Synthetic oligonucleotide
  Target: FXN; (+) strand; PAM type: YTN; PAM sequence: TTC
tttttgagatggagtcttgc

SEQ ID NO: 33970 - DNA, 20 bp, Artificial Sequence
  Description of Artificial Sequence: Synthetic oligonucleotide
  Target: FXN; (+) strand; PAM type: YTN; PAM sequence: CTT
tttgagatggagtcttgctc

SEQ ID NO: 33971 - DNA, 20 bp, Artificial Sequence
  Description of Artificial Sequence: Synthetic oligonucleotide
  Target: FXN; (+) strand; PAM type: YTN; PAM sequence: TTT
ttgagatggagtcttgctct

SEQ ID NO: 33972 - DNA, 20 bp, Artificial Sequence
  Description of Artificial Sequence: Synthetic oligonucleotide
  Target: FXN; (+) strand; PAM type: YTN; PAM sequence: TTT
tgagatggagtcttgctctg

SEQ ID NO: 33973 - DNA, 20 bp, Artificial Sequence
  Description of Artificial Sequence: Synthetic oligonucleotide
  Target: FXN; (+) strand; PAM type: YTN; PAM sequence: TTT
gagatggagtcttgctctgt

SEQ ID NO: 33974 - DNA, 20 bp, Artificial Sequence
  Description of Artificial Sequence: Synthetic oligonucleotide
  Target: FXN; (+) strand; PAM type: YTN; PAM sequence: TTG
agatggagtcttgctctgtt

SEQ ID NO: 33975 - DNA, 20 bp, Artificial Sequence
  Description of Artificial Sequence: Synthetic oligonucleotide
  Target: FXN; (+) strand; PAM type: YTN; PAM sequence: CTT
gctctgttgcccaggctgga

SEQ ID NO: 33976 - DNA, 20 bp, Artificial Sequence
  Description of Artificial Sequence: Synthetic oligonucleotide
  Target: FXN; (+) strand; PAM type: YTN; PAM sequence: TTG
ctctgttgcccaggctggag

SEQ ID NO: 33977 - DNA, 20 bp, Artificial Sequence
  Description of Artificial Sequence: Synthetic oligonucleotide
  Target: FXN; (+) strand; PAM type: YTN; PAM sequence: CTC
tgttgcccaggctggagtgt

SEQ ID NO: 33978 - DNA, 20 bp, Artificial Sequence
  Description of Artificial Sequence: Synthetic oligonucleotide
  Target: FXN; (+) strand; PAM type: YTN; PAM sequence: CTG
ttgcccaggctggagtgtag

SEQ ID NO: 33979 - DNA, 20 bp, Artificial Sequence
  Description of Artificial Sequence: Synthetic oligonucleotide
  Target: FXN; (+) strand; PAM type: YTN; PAM sequence: TTG
cccaggctggagtgtagtgg

SEQ ID NO: 33980 - DNA, 20 bp, Artificial Sequence
  Description of Artificial Sequence: Synthetic oligonucleotide
  Target: FXN; (+) strand; PAM type: YTN; PAM sequence: CTG
gagtgtagtggtgtgatctc

SEQ ID NO: 33981 - DNA, 20 bp, Artificial Sequence
  Description of Artificial Sequence: Synthetic oligonucleotide
  Target: FXN; (+) strand; PAM type: YTN; PAM sequence: CTC
agctcatcgcaacctccacc

SEQ ID NO: 33982 - DNA, 20 bp, Artificial Sequence
  Description of Artificial Sequence: Synthetic oligonucleotide
  Target: FXN; (+) strand; PAM type: YTN; PAM sequence: CTC
atcgcaacctccacctcctg

SEQ ID NO: 33983 - DNA, 20 bp, Artificial Sequence
  Description of Artificial Sequence: Synthetic oligonucleotide
  Target: FXN; (+) strand; PAM type: YTN; PAM sequence: CTC
cacctcctgggttcaagtga

SEQ ID NO: 33984 - DNA, 20 bp, Artificial Sequence
  Description of Artificial Sequence: Synthetic oligonucleotide
  Target: FXN; (+) strand; PAM type: YTN; PAM sequence: CTC
ctgggttcaagtgattctct

SEQ ID NO: 33985 - DNA, 20 bp, Artificial Sequence
  Description of Artificial Sequence: Synthetic oligonucleotide
  Target: FXN; (+) strand; PAM type: YTN; PAM sequence: CTG
ggttcaagtgattctcttgc

SEQ ID NO: 33986 - DNA, 20 bp, Artificial Sequence
  Description of Artificial Sequence: Synthetic oligonucleotide
  Target: FXN; (+) strand; PAM type: YTN; PAM sequence: TTC
aagtgattctcttgcctcag

SEQ ID NO: 33987 - DNA, 20 bp, Artificial Sequence
  Description of Artificial Sequence: Synthetic oligonucleotide
  Target: FXN; (+) strand; PAM type: YTN; PAM sequence: TTC
tcttgcctcagcctcccgag

SEQ ID NO: 33988 - DNA, 20 bp, Artificial Sequence
  Description of Artificial Sequence: Synthetic oligonucleotide
  Target: FXN; (+) strand; PAM type: YTN; PAM sequence: CTC
ttgcctcagcctcccgagta

SEQ ID NO: 33989 - DNA, 20 bp, Artificial Sequence
  Description of Artificial Sequence: Synthetic oligonucleotide
  Target: FXN; (+) strand; PAM type: YTN; PAM sequence: CTT
gcctcagcctcccgagtagc

SEQ ID NO: 33990 - DNA, 20 bp, Artificial Sequence
  Description of Artificial Sequence: Synthetic oligonucleotide
  Target: FXN; (+) strand; PAM type: YTN; PAM sequence: TTG
cctcagcctcccgagtagct

SEQ ID NO: 33991 - DNA, 20 bp, Artificial Sequence
  Description of Artificial Sequence: Synthetic oligonucleotide
  Target: FXN; (+) strand; PAM type: YTN; PAM sequence: CTC
agcctcccgagtagctggga

SEQ ID NO: 33992 - DNA, 20 bp, Artificial Sequence
  Description of Artificial Sequence: Synthetic oligonucleotide
  Target: FXN; (+) strand; PAM type: YTN; PAM sequence: CTC
ccgagtagctgggattacag

SEQ ID NO: 33993 - DNA, 20 bp, Artificial Sequence
  Description of Artificial Sequence: Synthetic oligonucleotide
  Target: FXN; (+) strand; PAM type: YTN; PAM sequence: CTG
ggattacaggcgcctgccac

SEQ ID NO: 33994 - DNA, 20 bp, Artificial Sequence
  Description of Artificial Sequence: Synthetic oligonucleotide
  Target: FXN; (+) strand; PAM type: YTN; PAM sequence: TTA
caggcgcctgccaccacgcc

SEQ ID NO: 33995 - DNA, 20 bp, Artificial Sequence
  Description of Artificial Sequence: Synthetic oligonucleotide
  Target: FXN; (+) strand; PAM type: YTN; PAM sequence: CTG
ccaccacgcctggctaattt

SEQ ID NO: 33996 - DNA, 20 bp, Artificial Sequence
  Description of Artificial Sequence: Synthetic oligonucleotide
  Target: FXN; (+) strand; PAM type: YTN; PAM sequence: CTG
gctaatttttttatattttt

SEQ ID NO: 33997 - DNA, 20 bp, Artificial Sequence
  Description of Artificial Sequence: Synthetic oligonucleotide
  Target: FXN; (+) strand; PAM type: YTN; PAM sequence: CTA
atttttttatatttttagta

SEQ ID NO: 33998 - DNA, 20 bp, Artificial Sequence
  Description of Artificial Sequence: Synthetic oligonucleotide
  Target: FXN; (+) strand; PAM type: YTN; PAM sequence: TTT
ttttatatttttagtagaga

SEQ ID NO: 33999 - DNA, 20 bp, Artificial Sequence
  Description of Artificial Sequence: Synthetic oligonucleotide
  Target: FXN; (+) strand; PAM type: YTN; PAM sequence: TTT
tttatatttttagtagagac

SEQ ID NO: 34000 - DNA, 20 bp, Artificial Sequence
  Description of Artificial Sequence: Synthetic oligonucleotide
  Target: FXN; (+) strand; PAM type: YTN; PAM sequence: TTT
ttatatttttagtagagact

SEQ ID NO: 34001 - DNA, 20 bp, Artificial Sequence
  Description of Artificial Sequence: Synthetic oligonucleotide
  Target: FXN; (+) strand; PAM type: YTN; PAM sequence: TTT
tatatttttagtagagactg

SEQ ID NO: 34002 - DNA, 20 bp, Artificial Sequence
  Description of Artificial Sequence: Synthetic oligonucleotide
  Target: FXN; (+) strand; PAM type: YTN; PAM sequence: TTT
atatttttagtagagactgg

SEQ ID NO: 34003 - DNA, 20 bp, Artificial Sequence
  Description of Artificial Sequence: Synthetic oligonucleotide
  Target: FXN; (+) strand; PAM type: YTN; PAM sequence: TTA
tatttttagtagagactggg

SEQ ID NO: 34004 - DNA, 20 bp, Artificial Sequence
  Description of Artificial Sequence: Synthetic oligonucleotide
  Target: FXN; (+) strand; PAM type: YTN; PAM sequence: TTT
ttagtagagactgggttttg

SEQ ID NO: 34005 - DNA, 20 bp, Artificial Sequence
  Description of Artificial Sequence: Synthetic oligonucleotide
  Target: FXN; (+) strand; PAM type: YTN; PAM sequence: TTT
tagtagagactgggttttgc

SEQ ID NO: 34006 - DNA, 20 bp, Artificial Sequence
  Description of Artificial Sequence: Synthetic oligonucleotide
  Target: FXN; (+) strand; PAM type: YTN; PAM sequence: TTT
agtagagactgggttttgcc

SEQ ID NO: 34007 - DNA, 20 bp, Artificial Sequence
  Description of Artificial Sequence: Synthetic oligonucleotide
  Target: FXN; (+) strand; PAM type: YTN; PAM sequence: TTA
gtagagactgggttttgcca

SEQ ID NO: 34008 - DNA, 20 bp, Artificial Sequence
  Description of Artificial Sequence: Synthetic oligonucleotide
  Target: FXN; (+) strand; PAM type: YTN; PAM sequence: CTG
ggttttgccatgttgtcagg

SEQ ID NO: 34009 - DNA, 20 bp, Artificial Sequence
  Description of Artificial Sequence: Synthetic oligonucleotide
  Target: FXN; (+) strand; PAM type: YTN; PAM sequence: TTT
tgccatgttgtcaggctagt

SEQ ID NO: 34010 - DNA, 20 bp, Artificial Sequence
  Description of Artificial Sequence: Synthetic oligonucleotide
  Target: FXN; (+) strand; PAM type: YTN; PAM sequence: TTT
gccatgttgtcaggctagtc

SEQ ID NO: 34011 - DNA, 20 bp, Artificial Sequence
  Description of Artificial Sequence: Synthetic oligonucleotide
  Target: FXN; (+) strand; PAM type: YTN; PAM sequence: TTG
ccatgttgtcaggctagtct

SEQ ID NO: 34012 - DNA, 20 bp, Artificial Sequence
  Description of Artificial Sequence: Synthetic oligonucleotide
  Target: FXN; (+) strand; PAM type: YTN; PAM sequence: TTG
tcaggctagtcttgaactcc

SEQ ID NO: 34013 - DNA, 20 bp, Artificial Sequence
  Description of Artificial Sequence: Synthetic oligonucleotide
  Target: FXN; (+) strand; PAM type: YTN; PAM sequence: CTA
gtcttgaactcctgacctca

SEQ ID NO: 34014 - DNA, 20 bp, Artificial Sequence
  Description of Artificial Sequence: Synthetic oligonucleotide
  Target: FXN; (+) strand; PAM type: YTN; PAM sequence: CTT
gaactcctgacctcaggtaa

SEQ ID NO: 34015 - DNA, 20 bp, Artificial Sequence
  Description of Artificial Sequence: Synthetic oligonucleotide
  Target: FXN; (+) strand; PAM type: YTN; PAM sequence: TTG
aactcctgacctcaggtaat

SEQ ID NO: 34016 - DNA, 20 bp, Artificial Sequence
  Description of Artificial Sequence: Synthetic oligonucleotide
  Target: FXN; (+) strand; PAM type: YTN; PAM sequence: CTC
ctgacctcaggtaatccaac

SEQ ID NO: 34017 - DNA, 20 bp, Artificial Sequence
  Description of Artificial Sequence: Synthetic oligonucleotide
  Target: FXN; (+) strand; PAM type: YTN; PAM sequence: CTG
acctcaggtaatccaactgc

SEQ ID NO: 34018 - DNA, 20 bp, Artificial Sequence
  Description of Artificial Sequence: Synthetic oligonucleotide
  Target: FXN; (+) strand; PAM type: YTN; PAM sequence: CTC
aggtaatccaactgctttgg

SEQ ID NO: 34019 - DNA, 20 bp, Artificial Sequence
  Description of Artificial Sequence: Synthetic oligonucleotide
  Target: FXN; (+) strand; PAM type: YTN; PAM sequence: CTG
ctttggcctcccaaagtgct

SEQ ID NO: 34020 - DNA, 20 bp, Artificial Sequence
  Description of Artificial Sequence: Synthetic oligonucleotide
  Target: FXN; (+) strand; PAM type: YTN; PAM sequence: CTT
tggcctcccaaagtgctggg

SEQ ID NO: 34021 - DNA, 20 bp, Artificial Sequence
  Description of Artificial Sequence: Synthetic oligonucleotide
  Target: FXN; (+) strand; PAM type: YTN; PAM sequence: TTT
ggcctcccaaagtgctggga

SEQ ID NO: 34022 - DNA, 20 bp, Artificial Sequence
  Description of Artificial Sequence: Synthetic oligonucleotide
  Target: FXN; (+) strand; PAM type: YTN; PAM sequence: TTG
gcctcccaaagtgctgggat

SEQ ID NO: 34023 - DNA, 20 bp, Artificial Sequence
  Description of Artificial Sequence: Synthetic oligonucleotide
  Target: FXN; (+) strand; PAM type: YTN; PAM sequence: CTC
ccaaagtgctgggattacag

SEQ ID NO: 34024 - DNA, 20 bp, Artificial Sequence
  Description of Artificial Sequence: Synthetic oligonucleotide
  Target: FXN; (+) strand; PAM type: YTN; PAM sequence: CTG
ggattacaggcagctccaaa

SEQ ID NO: 34025 - DNA, 20 bp, Artificial Sequence
  Description of Artificial Sequence: Synthetic oligonucleotide
  Target: FXN; (+) strand; PAM type: YTN; PAM sequence: TTA
caggcagctccaaagtgctg

SEQ ID NO: 34026 - DNA, 20 bp, Artificial Sequence
  Description of Artificial Sequence: Synthetic oligonucleotide
  Target: FXN; (+) strand; PAM type: YTN; PAM sequence: CTC
caaagtgctgggattacagg

SEQ ID NO: 34027 - DNA, 20 bp, Artificial Sequence
  Description of Artificial Sequence: Synthetic oligonucleotide
  Target: FXN; (+) strand; PAM type: YTN; PAM sequence: CTG
ggattacaggcatgagccac

SEQ ID NO: 34028 - DNA, 20 bp, Artificial Sequence
  Description of Artificial Sequence: Synthetic oligonucleotide
  Target: FXN; (+) strand; PAM type: YTN; PAM sequence: TTA
caggcatgagccaccatgca

SEQ ID NO: 34029 - DNA, 20 bp, Artificial Sequence
  Description of Artificial Sequence: Synthetic oligonucleotide
  Target: FXN; (+) strand; PAM type: YTN; PAM sequence: CTG
aaataatttttttgaaaggg

SEQ ID NO: 34030 - DNA, 20 bp, Artificial Sequence
  Description of Artificial Sequence: Synthetic oligonucleotide
  Target: FXN; (+) strand; PAM type: YTN; PAM sequence: TTT
ttttgaaagggctagtttct

SEQ ID NO: 34031 - DNA, 20 bp, Artificial Sequence
  Description of Artificial Sequence: Synthetic oligonucleotide
  Target: FXN; (+) strand; PAM type: YTN; PAM sequence: TTT
tttgaaagggctagtttcta

SEQ ID NO: 34032 - DNA, 20 bp, Artificial Sequence
  Description of Artificial Sequence: Synthetic oligonucleotide
  Target: FXN; (+) strand; PAM type: YTN; PAM sequence: TTT
ttgaaagggctagtttctat

SEQ ID NO: 34033 - DNA, 20 bp, Artificial Sequence
  Description of Artificial Sequence: Synthetic oligonucleotide
  Target: FXN; (+) strand; PAM type: YTN; PAM sequence: TTT
tgaaagggctagtttctatt

SEQ ID NO: 34034 - DNA, 20 bp, Artificial Sequence
  Description of Artificial Sequence: Synthetic oligonucleotide
  Target: FXN; (+) strand; PAM type: YTN; PAM sequence: TTT
gaaagggctagtttctattt

SEQ ID NO: 34035 - DNA, 20 bp, Artificial Sequence
  Description of Artificial Sequence: Synthetic oligonucleotide
  Target: FXN; (+) strand; PAM type: YTN; PAM sequence: TTG
aaagggctagtttctattta

SEQ ID NO: 34036 - DNA, 20 bp, Artificial Sequence
  Description of Artificial Sequence: Synthetic oligonucleotide
  Target: FXN; (+) strand; PAM type: YTN; PAM sequence: CTA
gtttctatttagcccttagg

SEQ ID NO: 34037 - DNA, 20 bp, Artificial Sequence
  Description of Artificial Sequence: Synthetic oligonucleotide
  Target: FXN; (+) strand; PAM type: YTN; PAM sequence: TTT
ctatttagcccttaggggaa

SEQ ID NO: 34038 - DNA, 20 bp, Artificial Sequence
  Description of Artificial Sequence: Synthetic oligonucleotide
  Target: FXN; (+) strand; PAM type: YTN; PAM sequence: TTC
tatttagcccttaggggaaa

SEQ ID NO: 34039 - DNA, 20 bp, Artificial Sequence
  Description of Artificial Sequence: Synthetic oligonucleotide
  Target: FXN; (+) strand; PAM type: YTN; PAM sequence: CTA
tttagcccttaggggaaaaa

SEQ ID NO: 34040 - DNA, 20 bp, Artificial Sequence
  Description of Artificial Sequence: Synthetic oligonucleotide
  Target: FXN; (+) strand; PAM type: YTN; PAM sequence: TTT
agcccttaggggaaaaaaaa

SEQ ID NO: 34041 - DNA, 20 bp, Artificial Sequence
  Description of Artificial Sequence: Synthetic oligonucleotide
  Target: FXN; (+) strand; PAM type: YTN; PAM sequence: TTA
gcccttaggggaaaaaaaac

SEQ ID NO: 34042 - DNA, 20 bp, Artificial Sequence
  Description of Artificial Sequence: Synthetic oligonucleotide
  Target: FXN; (+) strand; PAM type: YTN; PAM sequence: CTT
aggggaaaaaaaactaatgg

SEQ ID NO: 34043 - DNA, 20 bp, Artificial Sequence
  Description of Artificial Sequence: Synthetic oligonucleotide
  Target: FXN; (+) strand; PAM type: YTN; PAM sequence: TTA
ggggaaaaaaaactaatggc

SEQ ID NO: 34044 - DNA, 20 bp, Artificial Sequence
  Description of Artificial Sequence: Synthetic oligonucleotide
  Target: FXN; (+) strand; PAM type: YTN; PAM sequence: CTA
atggcagttagggagggaat

SEQ ID NO: 34045 - DNA, 20 bp, Artificial Sequence
  Description of Artificial Sequence: Synthetic oligonucleotide
  Target: FXN; (+) strand; PAM type: YTN; PAM sequence: TTA
gggagggaatagaacgagtc

SEQ ID NO: 34046 - DNA, 20 bp, Artificial Sequence
  Description of Artificial Sequence: Synthetic oligonucleotide
  Target: FXN; (+) strand; PAM type: YTN; PAM sequence: CTG
tttgaactcctttcccatca

SEQ ID NO: 34047 - DNA, 20 bp, Artificial Sequence
  Description of Artificial Sequence: Synthetic oligonucleotide
  Target: FXN; (+) strand; PAM type: YTN; PAM sequence: TTT
gaactcctttcccatcatgg

SEQ ID NO: 34048 - DNA, 20 bp, Artificial Sequence
  Description of Artificial Sequence: Synthetic oligonucleotide
  Target: FXN; (+) strand; PAM type: YTN; PAM sequence: TTG
aactcctttcccatcatggc

SEQ ID NO: 34049 - DNA, 20 bp, Artificial Sequence
  Description of Artificial Sequence: Synthetic oligonucleotide
  Target: FXN; (+) strand; PAM type: YTN; PAM sequence: CTC
ctttcccatcatggccaaaa

SEQ ID NO: 34050 - DNA, 20 bp, Artificial Sequence
  Description of Artificial Sequence: Synthetic oligonucleotide
  Target: FXN; (+) strand; PAM type: YTN; PAM sequence: CTT
tcccatcatggccaaaactt

SEQ ID NO: 34051 - DNA, 20 bp, Artificial Sequence
  Description of Artificial Sequence: Synthetic oligonucleotide
  Target: FXN; (+) strand; PAM type: YTN; PAM sequence: TTT
cccatcatggccaaaactta

SEQ ID NO: 34052 - DNA, 20 bp, Artificial Sequence
  Description of Artificial Sequence: Synthetic oligonucleotide
  Target: FXN; (+) strand; PAM type: YTN; PAM sequence: TTC
ccatcatggccaaaacttaa

SEQ ID NO: 34053 - DNA, 20 bp, Artificial Sequence
  Description of Artificial Sequence: Synthetic oligonucleotide
  Target: FXN; (+) strand; PAM type: YTN; PAM sequence: CTT
aaaattttttttagatatct

SEQ ID NO: 34054 - DNA, 20 bp, Artificial Sequence
  Description of Artificial Sequence: Synthetic oligonucleotide
  Target: FXN; (+) strand; PAM type: YTN; PAM sequence: TTA
aaattttttttagatatctc

SEQ ID NO: 34055 - DNA, 20 bp, Artificial Sequence
  Description of Artificial Sequence: Synthetic oligonucleotide
  Target: FXN; (+) strand; PAM type: YTN; PAM sequence: TTT
tttttagatatctctgggct

SEQ ID NO: 34056 - DNA, 20 bp, Artificial Sequence
  Description of Artificial Sequence: Synthetic oligonucleotide
  Target: FXN; (+) strand; PAM type: YTN; PAM sequence: TTT
ttttagatatctctgggctc

SEQ ID NO: 34057 - DNA, 20 bp, Artificial Sequence
  Description of Artificial Sequence: Synthetic oligonucleotide
  Target: FXN; (+) strand; PAM type: YTN; PAM sequence: TTT
tttagatatctctgggctcc

SEQ ID NO: 34058 - DNA, 20 bp, Artificial Sequence
  Description of Artificial Sequence: Synthetic oligonucleotide
  Target: FXN; (+) strand; PAM type: YTN; PAM sequence: TTT
ttagatatctctgggctccc

SEQ ID NO: 34059 - DNA, 20 bp, Artificial Sequence
  Description of Artificial Sequence: Synthetic oligonucleotide
  Target: FXN; (+) strand; PAM type: YTN; PAM sequence: TTT
tagatatctctgggctcccc

SEQ ID NO: 34060 - DNA, 20 bp, Artificial Sequence
  Description of Artificial Sequence: Synthetic oligonucleotide
  Target: FXN; (+) strand; PAM type: YTN; PAM sequence: TTT
agatatctctgggctcccct

SEQ ID NO: 34061 - DNA, 20 bp, Artificial Sequence
  Description of Artificial Sequence: Synthetic oligonucleotide
  Target: FXN; (+) strand; PAM type: YTN; PAM sequence: TTA
gatatctctgggctcccctt

SEQ ID NO: 34062 - DNA, 20 bp, Artificial Sequence
  Description of Artificial Sequence: Synthetic oligonucleotide
  Target: FXN; (+) strand; PAM type: YTN; PAM sequence: CTC
tgggctccccttggccaaaa

SEQ ID NO: 34063 - DNA, 20 bp, Artificial Sequence
  Description of Artificial Sequence: Synthetic oligonucleotide
  Target: FXN; (+) strand; PAM type: YTN; PAM sequence: CTG
ggctccccttggccaaaaga

SEQ ID NO: 34064 - DNA, 20 bp, Artificial Sequence
  Description of Artificial Sequence: Synthetic oligonucleotide
  Target: FXN; (+) strand; PAM type: YTN; PAM sequence: CTC
cccttggccaaaagatagtt

SEQ ID NO: 34065 - DNA, 20 bp, Artificial Sequence
  Description of Artificial Sequence: Synthetic oligonucleotide
  Target: FXN; (+) strand; PAM type: YTN; PAM sequence: CTT
ggccaaaagatagtttgttg

SEQ ID NO: 34066 - DNA, 20 bp, Artificial Sequence
  Description of Artificial Sequence: Synthetic oligonucleotide
  Target: FXN; (+) strand; PAM type: YTN; PAM sequence: TTG
gccaaaagatagtttgttga

SEQ ID NO: 34067 - DNA, 20 bp, Artificial Sequence
  Description of Artificial Sequence: Synthetic oligonucleotide
  Target: FXN; (+) strand; PAM type: YTN; PAM sequence: TTT
gttgagtcagttgggagctt

SEQ ID NO: 34068 - DNA, 20 bp, Artificial Sequence
  Description of Artificial Sequence: Synthetic oligonucleotide
  Target: FXN; (+) strand; PAM type: YTN; PAM sequence: TTG
ttgagtcagttgggagctta

SEQ ID NO: 34069 - DNA, 20 bp, Artificial Sequence
  Description of Artificial Sequence: Synthetic oligonucleotide
  Target: FXN; (+) strand; PAM type: YTN; PAM sequence: TTG
agtcagttgggagcttagaa

SEQ ID NO: 34070 - DNA, 20 bp, Artificial Sequence
  Description of Artificial Sequence: Synthetic oligonucleotide
  Target: FXN; (+) strand; PAM type: YTN; PAM sequence: TTG
ggagcttagaattttgtttt

SEQ ID NO: 34071 - DNA, 20 bp, Artificial Sequence
  Description of Artificial Sequence: Synthetic oligonucleotide
  Target: FXN; (+) strand; PAM type: YTN; PAM sequence: CTT
agaattttgtttttatttct

SEQ ID NO: 34072 - DNA, 20 bp, Artificial Sequence
  Description of Artificial Sequence: Synthetic oligonucleotide
  Target: FXN; (+) strand; PAM type: YTN; PAM sequence: TTA
gaattttgtttttatttctc

SEQ ID NO: 34073 - DNA, 20 bp, Artificial Sequence
  Description of Artificial Sequence: Synthetic oligonucleotide
  Target: FXN; (+) strand; PAM type: YTN; PAM sequence: TTT
tgtttttatttctcacatca

SEQ ID NO: 34074 - DNA, 20 bp, Artificial Sequence
  Description of Artificial Sequence: Synthetic oligonucleotide
  Target: FXN; (+) strand; PAM type: YTN; PAM sequence: TTT
gtttttatttctcacatcat

SEQ ID NO: 34075 - DNA, 20 bp, Artificial Sequence
  Description of Artificial Sequence: Synthetic oligonucleotide
  Target: FXN; (+) strand; PAM type: YTN; PAM sequence: TTG
tttttatttctcacatcatt

SEQ ID NO: 34076 - DNA, 20 bp, Artificial Sequence
  Description of Artificial Sequence: Synthetic oligonucleotide
  Target: FXN; (+) strand; PAM type: YTN; PAM sequence: TTT
ttatttctcacatcattgaa

SEQ ID NO: 34077 - DNA, 20 bp, Artificial Sequence
  Description of Artificial Sequence: Synthetic oligonucleotide
  Target: FXN; (+) strand; PAM type: YTN; PAM sequence: TTT
tatttctcacatcattgaat

SEQ ID NO: 34078 - DNA, 20 bp, Artificial Sequence
  Description of Artificial Sequence: Synthetic oligonucleotide
  Target: FXN; (+) strand; PAM type: YTN; PAM sequence: TTT
atttctcacatcattgaatc

SEQ ID NO: 34079 - DNA, 20 bp, Artificial Sequence
  Description of Artificial Sequence: Synthetic oligonucleotide
  Target: FXN; (+) strand; PAM type: YTN; PAM sequence: TTA
tttctcacatcattgaatca

SEQ ID NO: 34080 - DNA, 20 bp, Artificial Sequence
  Description of Artificial Sequence: Synthetic oligonucleotide
  Target: FXN; (+) strand; PAM type: YTN; PAM sequence: TTT
ctcacatcattgaatcaatt

SEQ ID NO: 34081 - DNA, 20 bp, Artificial Sequence
  Description of Artificial Sequence: Synthetic oligonucleotide
  Target: FXN; (+) strand; PAM type: YTN; PAM sequence: TTC
tcacatcattgaatcaattt

SEQ ID NO: 34082 - DNA, 20 bp, Artificial Sequence
  Description of Artificial Sequence: Synthetic oligonucleotide
  Target: FXN; (+) strand; PAM type: YTN; PAM sequence: CTC
acatcattgaatcaatttga

SEQ ID NO: 34083 - DNA, 20 bp, Artificial Sequence
  Description of Artificial Sequence: Synthetic oligonucleotide
  Target: FXN; (+) strand; PAM type: YTN; PAM sequence: TTG
aatcaatttgaaccaggcga

SEQ ID NO: 34084 - DNA, 20 bp, Artificial Sequence
  Description of Artificial Sequence: Synthetic oligonucleotide
  Target: FXN; (+) strand; PAM type: YTN; PAM sequence: TTT
gaaccaggcgacaaaacctt

SEQ ID NO: 34085 - DNA, 20 bp, Artificial Sequence
  Description of Artificial Sequence: Synthetic oligonucleotide
  Target: FXN; (+) strand; PAM type: YTN; PAM sequence: TTG
aaccaggcgacaaaaccttc

SEQ ID NO: 34086 - DNA, 20 bp, Artificial Sequence
  Description of Artificial Sequence: Synthetic oligonucleotide
  Target: FXN; (+) strand; PAM type: YTN; PAM sequence: CTT
ctgctcccagtagtgggtca

SEQ ID NO: 34087 - DNA, 20 bp, Artificial Sequence
  Description of Artificial Sequence: Synthetic oligonucleotide
  Target: FXN; (+) strand; PAM type: YTN; PAM sequence: TTC
tgctcccagtagtgggtcag

SEQ ID NO: 34088 - DNA, 20 bp, Artificial Sequence
  Description of Artificial Sequence: Synthetic oligonucleotide
  Target: FXN; (+) strand; PAM type: YTN; PAM sequence: CTG
ctcccagtagtgggtcagag

SEQ ID NO: 34089 - DNA, 20 bp, Artificial Sequence
  Description of Artificial Sequence: Synthetic oligonucleotide
  Target: FXN; (+) strand; PAM type: YTN; PAM sequence: CTC
ccagtagtgggtcagagaac

SEQ ID NO: 34090 - DNA, 20 bp, Artificial Sequence
  Description of Artificial Sequence: Synthetic oligonucleotide
  Target: FXN; (+) strand; PAM type: YTN; PAM sequence: CTT
cctgattcctgccctgagat

SEQ ID NO: 34091 - DNA, 20 bp, Artificial Sequence
  Description of Artificial Sequence: Synthetic oligonucleotide
  Target: FXN; (+) strand; PAM type: YTN; PAM sequence: TTC
ctgattcctgccctgagatt

SEQ ID NO: 34092 - DNA, 20 bp, Artificial Sequence
  Description of Artificial Sequence: Synthetic oligonucleotide
  Target: FXN; (+) strand; PAM type: YTN; PAM sequence: CTG
attcctgccctgagattgtc

SEQ ID NO: 34093 - DNA, 20 bp, Artificial Sequence
  Description of Artificial Sequence: Synthetic oligonucleotide
  Target: FXN; (+) strand; PAM type: YTN; PAM sequence: TTC
ctgccctgagattgtctctc

SEQ ID NO: 34094 - DNA, 20 bp, Artificial Sequence
  Description of Artificial Sequence: Synthetic oligonucleotide
  Target: FXN; (+) strand; PAM type: YTN; PAM sequence: CTG
ccctgagattgtctctctga

SEQ ID NO: 34095 - DNA, 20 bp, Artificial Sequence
  Description of Artificial Sequence: Synthetic oligonucleotide
  Target: FXN; (+) strand; PAM type: YTN; PAM sequence: CTG
agattgtctctctgaagaca

SEQ ID NO: 34096 - DNA, 20 bp, Artificial Sequence
  Description of Artificial Sequence: Synthetic oligonucleotide
  Target: FXN; (+) strand; PAM type: YTN; PAM sequence: TTG
tctctctgaagacaacatta

SEQ ID NO: 34097 - DNA, 20 bp, Artificial Sequence
  Description of Artificial Sequence: Synthetic oligonucleotide
  Target: FXN; (+) strand; PAM type: YTN; PAM sequence: CTC
tctgaagacaacattaggct

SEQ ID NO: 34098 - DNA, 20 bp, Artificial Sequence
  Description of Artificial Sequence: Synthetic oligonucleotide
  Target: FXN; (+) strand; PAM type: YTN; PAM sequence: CTC
tgaagacaacattaggctag

SEQ ID NO: 34099 - DNA, 20 bp, Artificial Sequence
  Description of Artificial Sequence: Synthetic oligonucleotide
  Target: FXN; (+) strand; PAM type: YTN; PAM sequence: CTG
aagacaacattaggctagta

SEQ ID NO: 34100 - DNA, 20 bp, Artificial Sequence
  Description of Artificial Sequence: Synthetic oligonucleotide
  Target: FXN; (+) strand; PAM type: YTN; PAM sequence: TTA
ggctagtaggctttccagat

SEQ ID NO: 34101 - DNA, 20 bp, Artificial Sequence
  Description of Artificial Sequence: Synthetic oligonucleotide
  Target: FXN; (+) strand; PAM type: YTN; PAM sequence: CTA
gtaggctttccagattctgt

SEQ ID NO: 34102 - DNA, 20 bp, Artificial Sequence
  Description of Artificial Sequence: Synthetic oligonucleotide
  Target: FXN; (+) strand; PAM type: YTN; PAM sequence: CTT
tccagattctgtaacccatt

SEQ ID NO: 34103 - DNA, 20 bp, Artificial Sequence
  Description of Artificial Sequence: Synthetic oligonucleotide
  Target: FXN; (+) strand; PAM type: YTN; PAM sequence: TTT
ccagattctgtaacccattc

SEQ ID NO: 34104 - DNA, 20 bp, Artificial Sequence
  Description of Artificial Sequence: Synthetic oligonucleotide
  Target: FXN; (+) strand; PAM type: YTN; PAM sequence: TTC
cagattctgtaacccattct

SEQ ID NO: 34105 - DNA, 20 bp, Artificial Sequence
  Description of Artificial Sequence: Synthetic oligonucleotide
  Target: FXN; (+) strand; PAM type: YTN; PAM sequence: TTC
tgtaacccattctttcaaag

SEQ ID NO: 34106 - DNA, 20 bp, Artificial Sequence
  Description of Artificial Sequence: Synthetic oligonucleotide
  Target: FXN; (+) strand; PAM type: YTN; PAM sequence: CTG
taacccattctttcaaagga

SEQ ID NO: 34107 - DNA, 20 bp, Artificial Sequence
  Description of Artificial Sequence: Synthetic oligonucleotide
  Target: FXN; (+) strand; PAM type: YTN; PAM sequence: TTC
tttcaaaggaagagatgcct

SEQ ID NO: 34108 - DNA, 20 bp, Artificial Sequence
  Description of Artificial Sequence: Synthetic oligonucleotide
  Target: FXN; (+) strand; PAM type: YTN; PAM sequence: CTT
tcaaaggaagagatgcctat

SEQ ID NO: 34109 - DNA, 20 bp, Artificial Sequence
  Description of Artificial Sequence: Synthetic oligonucleotide
  Target: FXN; (+) strand; PAM type: YTN; PAM sequence: TTT
caaaggaagagatgcctata

SEQ ID NO: 34110 - DNA, 20 bp, Artificial Sequence
  Description of Artificial Sequence: Synthetic oligonucleotide
  Target: FXN; (+) strand; PAM type: YTN; PAM sequence: TTC
aaaggaagagatgcctatat

SEQ ID NO: 34111 - DNA, 20 bp, Artificial Sequence
  Description of Artificial Sequence: Synthetic oligonucleotide
  Target: FXN; (+) strand; PAM type: YTN; PAM sequence: CTA
tatttttctagccaattcat

SEQ ID NO: 34112 - DNA, 20 bp, Artificial Sequence
  Description of Artificial Sequence: Synthetic oligonucleotide
  Target: FXN; (+) strand; PAM type: YTN; PAM sequence: TTT
ttctagccaattcatatacc

SEQ ID NO: 34113 - DNA, 20 bp, Artificial Sequence
  Description of Artificial Sequence: Synthetic oligonucleotide
  Target: FXN; (+) strand; PAM type: YTN; PAM sequence: TTT
tctagccaattcatatacct

SEQ ID NO: 34114 - DNA, 20 bp, Artificial Sequence
  Description of Artificial Sequence: Synthetic oligonucleotide
  Target: FXN; (+) strand; PAM type: YTN; PAM sequence: TTT
ctagccaattcatatacctt

SEQ ID NO: 34115 - DNA, 20 bp, Artificial Sequence
  Description of Artificial Sequence: Synthetic oligonucleotide
  Target: FXN; (+) strand; PAM type: YTN; PAM sequence: TTC
tagccaattcatataccttg

SEQ ID NO: 34116 - DNA, 20 bp, Artificial Sequence
  Description of Artificial Sequence: Synthetic oligonucleotide
  Target: FXN; (+) strand; PAM type: YTN; PAM sequence: CTA
gccaattcatataccttgag

SEQ ID NO: 34117 - DNA, 20 bp, Artificial Sequence
  Description of Artificial Sequence: Synthetic oligonucleotide
  Target: FXN; (+) strand; PAM type: YTN; PAM sequence: TTC
atataccttgagtatcactc

SEQ ID NO: 34118 - DNA, 20 bp, Artificial Sequence
  Description of Artificial Sequence: Synthetic oligonucleotide
  Target: FXN; (+) strand; PAM type: YTN; PAM sequence: CTT
gagtatcactcaagggcaaa

SEQ ID NO: 34119 - DNA, 20 bp, Artificial Sequence
  Description of Artificial Sequence: Synthetic oligonucleotide
  Target: FXN; (+) strand; PAM type: YTN; PAM sequence: TTG
agtatcactcaagggcaaaa

SEQ ID NO: 34120 - DNA, 20 bp, Artificial Sequence
  Description of Artificial Sequence: Synthetic oligonucleotide
  Target: FXN; (+) strand; PAM type: YTN; PAM sequence: CTC
aagggcaaaattatttctaa

SEQ ID NO: 34121 - DNA, 20 bp, Artificial Sequence
  Description of Artificial Sequence: Synthetic oligonucleotide
  Target: FXN; (+) strand; PAM type: YTN; PAM sequence: TTA
tttctaacaaatcatttact

SEQ ID NO: 34122 - DNA, 20 bp, Artificial Sequence
  Description of Artificial Sequence: Synthetic oligonucleotide
  Target: FXN; (+) strand; PAM type: YTN; PAM sequence: TTT
ctaacaaatcatttactaat

SEQ ID NO: 34123 - DNA, 20 bp, Artificial Sequence
  Description of Artificial Sequence: Synthetic oligonucleotide
  Target: FXN; (+) strand; PAM type: YTN; PAM sequence: TTC
taacaaatcatttactaatt

SEQ ID NO: 34124 - DNA, 20 bp, Artificial Sequence
  Description of Artificial Sequence: Synthetic oligonucleotide
  Target: FXN; (+) strand; PAM type: YTN; PAM sequence: CTA
acaaatcatttactaattag

SEQ ID NO: 34125 - DNA, 20 bp, Artificial Sequence
  Description of Artificial Sequence: Synthetic oligonucleotide
  Target: FXN; (+) strand; PAM type: YTN; PAM sequence: TTT
actaattagcaaatgcttaa

SEQ ID NO: 34126 - DNA, 20 bp, Artificial Sequence
  Description of Artificial Sequence: Synthetic oligonucleotide
  Target: FXN; (+) strand; PAM type: YTN; PAM sequence: TTA
ctaattagcaaatgcttaag

SEQ ID NO: 34127 - DNA, 20 bp, Artificial Sequence
  Description of Artificial Sequence: Synthetic oligonucleotide
  Target: FXN; (+) strand; PAM type: YTN; PAM sequence: CTA
attagcaaatgcttaagtgt

SEQ ID NO: 34128 - DNA, 20 bp, Artificial Sequence
  Description of Artificial Sequence: Synthetic oligonucleotide
  Target: FXN; (+) strand; PAM type: YTN; PAM sequence: TTA
gcaaatgcttaagtgtagat

SEQ ID NO: 34129 - DNA, 20 bp, Artificial Sequence
  Description of Artificial Sequence: Synthetic oligonucleotide
  Target: FXN; (+) strand; PAM type: YTN; PAM sequence: CTT
aagtgtagatttagaaagct

SEQ ID NO: 34130 - DNA, 20 bp, Artificial Sequence
  Description of Artificial Sequence: Synthetic oligonucleotide
  Target: FXN; (+) strand; PAM type: YTN; PAM sequence: TTA
agtgtagatttagaaagcta

SEQ ID NO: 34131 - DNA, 20 bp, Artificial Sequence
  Description of Artificial Sequence: Synthetic oligonucleotide
  Target: FXN; (+) strand; PAM type: YTN; PAM sequence: TTT
agaaagctaaagctatacag

SEQ ID NO: 34132 - DNA, 20 bp, Artificial Sequence
  Description of Artificial Sequence: Synthetic oligonucleotide
  Target: FXN; (+) strand; PAM type: YTN; PAM sequence: TTA
gaaagctaaagctatacagt

SEQ ID NO: 34133 - DNA, 20 bp, Artificial Sequence
  Description of Artificial Sequence: Synthetic oligonucleotide
  Target: FXN; (+) strand; PAM type: YTN; PAM sequence: CTA
aagctatacagtggctgcca

SEQ ID NO: 34134 - DNA, 20 bp, Artificial Sequence
  Description of Artificial Sequence: Synthetic oligonucleotide
  Target: FXN; (+) strand; PAM type: YTN; PAM sequence: CTA
tacagtggctgccatctata

SEQ ID NO: 34135 - DNA, 20 bp, Artificial Sequence
  Description of Artificial Sequence: Synthetic oligonucleotide
  Target: FXN; (+) strand; PAM type: YTN; PAM sequence: CTG
ccatctatagtttggacttg

SEQ ID NO: 34136 - DNA, 20 bp, Artificial Sequence
  Description of Artificial Sequence: Synthetic oligonucleotide
  Target: FXN; (+) strand; PAM type: YTN; PAM sequence: CTA
tagtttggacttgtgattaa

SEQ ID NO: 34137 - DNA, 20 bp, Artificial Sequence
  Description of Artificial Sequence: Synthetic oligonucleotide
  Target: FXN; (+) strand; PAM type: YTN; PAM sequence: TTT
ggacttgtgattaactacat

SEQ ID NO: 34138 - DNA, 20 bp, Artificial Sequence
  Description of Artificial Sequence: Synthetic oligonucleotide
  Target: FXN; (+) strand; PAM type: YTN; PAM sequence: TTG
gacttgtgattaactacatt

SEQ ID NO: 34139 - DNA, 20 bp, Artificial Sequence
  Description of Artificial Sequence: Synthetic oligonucleotide
  Target: FXN; (+) strand; PAM type: YTN; PAM sequence: CTT
gtgattaactacattgaaat

SEQ ID NO: 34140 - DNA, 20 bp, Artificial Sequence
  Description of Artificial Sequence: Synthetic oligonucleotide
  Target: FXN; (+) strand; PAM type: YTN; PAM sequence: TTG
tgattaactacattgaaatg

SEQ ID NO: 34141 - DNA, 20 bp, Artificial Sequence
  Description of Artificial Sequence: Synthetic oligonucleotide
  Target: FXN; (+) strand; PAM type: YTN; PAM sequence: TTA
actacattgaaatgctaact

SEQ ID NO: 34142 - DNA, 20 bp, Artificial Sequence
  Description of Artificial Sequence: Synthetic oligonucleotide
  Target: FXN; (+) strand; PAM type: YTN; PAM sequence: CTA
cattgaaatgctaactctgt

SEQ ID NO: 34143 - DNA, 20 bp, Artificial Sequence
  Description of Artificial Sequence: Synthetic oligonucleotide
  Target: FXN; (+) strand; PAM type: YTN; PAM sequence: TTG
aaatgctaactctgtaccct

SEQ ID NO: 34144 - DNA, 20 bp, Artificial Sequence
  Description of Artificial Sequence: Synthetic oligonucleotide
  Target: FXN; (+) strand; PAM type: YTN; PAM sequence: CTA
actctgtaccctagagtatg

SEQ ID NO: 34145 - DNA, 20 bp, Artificial Sequence
  Description of Artificial Sequence: Synthetic oligonucleotide
  Target: FXN; (+) strand; PAM type: YTN; PAM sequence: CTC
tgtaccctagagtatgaatt

SEQ ID NO: 34146 - DNA, 20 bp, Artificial Sequence
  Description of Artificial Sequence: Synthetic oligonucleotide
  Target: FXN; (+) strand; PAM type: YTN; PAM sequence: CTG
taccctagagtatgaattcc

SEQ ID NO: 34147 - DNA, 20 bp, Artificial Sequence
  Description of Artificial Sequence: Synthetic oligonucleotide
  Target: FXN; (+) strand; PAM type: YTN; PAM sequence: CTA
gagtatgaattcctgattag

SEQ ID NO: 34148 - DNA, 20 bp, Artificial Sequence
  Description of Artificial Sequence: Synthetic oligonucleotide
  Target: FXN; (+) strand; PAM type: YTN; PAM sequence: TTC
ctgattagagtccttcaggt

SEQ ID NO: 34149 - DNA, 20 bp, Artificial Sequence
  Description of Artificial Sequence: Synthetic oligonucleotide
  Target: FXN; (+) strand; PAM type: YTN; PAM sequence: CTG
attagagtccttcaggtgct

SEQ ID NO: 34150 - DNA, 20 bp, Artificial Sequence
  Description of Artificial Sequence: Synthetic oligonucleotide
  Target: FXN; (+) strand; PAM type: YTN; PAM sequence: TTA
gagtccttcaggtgctaact

SEQ ID NO: 34151 - DNA, 20 bp, Artificial Sequence
  Description of Artificial Sequence: Synthetic oligonucleotide
  Target: FXN; (+) strand; PAM type: YTN; PAM sequence: CTT
caggtgctaactaatttatg

SEQ ID NO: 34152 - DNA, 20 bp, Artificial Sequence
  Description of Artificial Sequence: Synthetic oligonucleotide
  Target: FXN; (+) strand; PAM type: YTN; PAM sequence: TTC
aggtgctaactaatttatgt

SEQ ID NO: 34153 - DNA, 20 bp, Artificial Sequence
  Description of Artificial Sequence: Synthetic oligonucleotide
  Target: FXN; (+) strand; PAM type: YTN; PAM sequence: CTA
actaatttatgtatttcatg

SEQ ID NO: 34154 - DNA, 20 bp, Artificial Sequence
  Description of Artificial Sequence: Synthetic oligonucleotide
  Target: FXN; (+) strand; PAM type: YTN; PAM sequence: CTA
atttatgtatttcatgtttg

SEQ ID NO: 34155 - DNA, 20 bp, Artificial Sequence
  Description of Artificial Sequence: Synthetic oligonucleotide
  Target: FXN; (+) strand; PAM type: YTN; PAM sequence: TTT
atgtatttcatgtttgataa

SEQ ID NO: 34156 - DNA, 20 bp, Artificial Sequence
  Description of Artificial Sequence: Synthetic oligonucleotide
  Target: FXN; (+) strand; PAM type: YTN; PAM sequence: TTA
tgtatttcatgtttgataat

SEQ ID NO: 34157 - DNA, 20 bp, Artificial Sequence
  Description of Artificial Sequence: Synthetic oligonucleotide
  Target: FXN; (+) strand; PAM type: YTN; PAM sequence: TTT
catgtttgataatattatta

SEQ ID NO: 34158 - DNA, 20 bp, Artificial Sequence
  Description of Artificial Sequence: Synthetic oligonucleotide
  Target: FXN; (+) strand; PAM type: YTN; PAM sequence: TTC
atgtttgataatattattac

SEQ ID NO: 34159 - DNA, 20 bp, Artificial Sequence
  Description of Artificial Sequence: Synthetic oligonucleotide
  Target: FXN; (+) strand; PAM type: YTN; PAM sequence: TTT
gataatattattacttgagc

SEQ ID NO: 34160 - DNA, 20 bp, Artificial Sequence
  Description of Artificial Sequence: Synthetic oligonucleotide
  Target: FXN; (+) strand; PAM type: YTN; PAM sequence: TTG
ataatattattacttgagct

SEQ ID NO: 34161 - DNA, 20 bp, Artificial Sequence
  Description of Artificial Sequence: Synthetic oligonucleotide
  Target: FXN; (+) strand; PAM type: YTN; PAM sequence: TTA
ttacttgagctttgtgggag

SEQ ID NO: 34162 - DNA, 20 bp, Artificial Sequence
  Description of Artificial Sequence: Synthetic oligonucleotide
  Target: FXN; (+) strand; PAM type: YTN; PAM sequence: TTA
cttgagctttgtgggagagc

SEQ ID NO: 34163 - DNA, 20 bp, Artificial Sequence
  Description of Artificial Sequence: Synthetic oligonucleotide
  Target: FXN; (+) strand; PAM type: YTN; PAM sequence: CTT
gagctttgtgggagagcagt

SEQ ID NO: 34164 - DNA, 20 bp, Artificial Sequence
  Description of Artificial Sequence: Synthetic oligonucleotide
  Target: FXN; (+) strand; PAM type: YTN; PAM sequence: TTG
agctttgtgggagagcagtc

SEQ ID NO: 34165 - DNA, 20 bp, Artificial Sequence
  Description of Artificial Sequence: Synthetic oligonucleotide
  Target: FXN; (+) strand; PAM type: YTN; PAM sequence: CTT
tgtgggagagcagtcttttc

SEQ ID NO: 34166 - DNA, 20 bp, Artificial Sequence
  Description of Artificial Sequence: Synthetic oligonucleotide
  Target: FXN; (+) strand; PAM type: YTN; PAM sequence: TTT
gtgggagagcagtcttttcc

SEQ ID NO: 34167 - DNA, 20 bp, Artificial Sequence
  Description of Artificial Sequence: Synthetic oligonucleotide
  Target: FXN; (+) strand; PAM type: YTN; PAM sequence: TTG
tgggagagcagtcttttcct

SEQ ID NO: 34168 - DNA, 20 bp, Artificial Sequence
  Description of Artificial Sequence: Synthetic oligonucleotide
  Target: FXN; (+) strand; PAM type: YTN; PAM sequence: CTT
ttcctcccctgagatatagc

SEQ ID NO: 34169 - DNA, 20 bp, Artificial Sequence
  Description of Artificial Sequence: Synthetic oligonucleotide
  Target: FXN; (+) strand; PAM type: YTN; PAM sequence: TTT
tcctcccctgagatatagct

SEQ ID NO: 34170 - DNA, 20 bp, Artificial Sequence
  Description of Artificial Sequence: Synthetic oligonucleotide
  Target: FXN; (+) strand; PAM type: YTN; PAM sequence: TTT
cctcccctgagatatagcta

SEQ ID NO: 34171 - DNA, 20 bp, Artificial Sequence
  Description of Artificial Sequence: Synthetic oligonucleotide
  Target: FXN; (+) strand; PAM type: YTN; PAM sequence: TTC
ctcccctgagatatagctag

SEQ ID NO: 34172 - DNA, 20 bp, Artificial Sequence
  Description of Artificial Sequence: Synthetic oligonucleotide
  Target: FXN; (+) strand; PAM type: YTN; PAM sequence: CTC
ccctgagatatagctagaag

SEQ ID NO: 34173 - DNA, 20 bp, Artificial Sequence
  Description of Artificial Sequence: Synthetic oligonucleotide
  Target: FXN; (+) strand; PAM type: YTN; PAM sequence: CTG
agatatagctagaagttacc

SEQ ID NO: 34174 - DNA, 20 bp, Artificial Sequence
  Description of Artificial Sequence: Synthetic oligonucleotide
  Target: FXN; (+) strand; PAM type: YTN; PAM sequence: CTA
gaagttacctcctttgtgaa

SEQ ID NO: 34175 - DNA, 20 bp, Artificial Sequence
  Description of Artificial Sequence: Synthetic oligonucleotide
  Target: FXN; (+) strand; PAM type: YTN; PAM sequence: TTA
cctcctttgtgaagccttcc

SEQ ID NO: 34176 - DNA, 20 bp, Artificial Sequence
  Description of Artificial Sequence: Synthetic oligonucleotide
  Target: FXN; (+) strand; PAM type: YTN; PAM sequence: CTC
ctttgtgaagccttcctaga

SEQ ID NO: 34177 - DNA, 20 bp, Artificial Sequence
  Description of Artificial Sequence: Synthetic oligonucleotide
  Target: FXN; (+) strand; PAM type: YTN; PAM sequence: CTT
tgtgaagccttcctagatac

SEQ ID NO: 34178 - DNA, 20 bp, Artificial Sequence
  Description of Artificial Sequence: Synthetic oligonucleotide
  Target: FXN; (+) strand; PAM type: YTN; PAM sequence: TTT
gtgaagccttcctagatact

SEQ ID NO: 34179 - DNA, 20 bp, Artificial Sequence
  Description of Artificial Sequence: Synthetic oligonucleotide
  Target: FXN; (+) strand; PAM type: YTN; PAM sequence: TTG
tgaagccttcctagatactc

SEQ ID NO: 34180 - DNA, 20 bp, Artificial Sequence
  Description of Artificial Sequence: Synthetic oligonucleotide
  Target: FXN; (+) strand; PAM type: YTN; PAM sequence: CTT
cctagatactccaagcagac

SEQ ID NO: 34181 - DNA, 20 bp, Artificial Sequence
  Description of Artificial Sequence: Synthetic oligonucleotide
  Target: FXN; (+) strand; PAM type: YTN; PAM sequence: TTC
ctagatactccaagcagaca

SEQ ID NO: 34182 - DNA, 20 bp, Artificial Sequence
  Description of Artificial Sequence: Synthetic oligonucleotide
  Target: FXN; (+) strand; PAM type: YTN; PAM sequence: CTA
gatactccaagcagacacgg

SEQ ID NO: 34183 - DNA, 20 bp, Artificial Sequence
  Description of Artificial Sequence: Synthetic oligonucleotide
  Target: FXN; (+) strand; PAM type: YTN; PAM sequence: CTC
caagcagacacggtccttcc

SEQ ID NO: 34184 - DNA, 20 bp, Artificial Sequence
  Description of Artificial Sequence: Synthetic oligonucleotide
  Target: FXN; (+) strand; PAM type: YTN; PAM sequence: CTT
cctttctcccttgcccagca

SEQ ID NO: 34185 - DNA, 20 bp, Artificial Sequence
  Description of Artificial Sequence: Synthetic oligonucleotide
  Target: FXN; (+) strand; PAM type: YTN; PAM sequence: TTC
ctttctcccttgcccagcac

SEQ ID NO: 34186 - DNA, 20 bp, Artificial Sequence
  Description of Artificial Sequence: Synthetic oligonucleotide
  Target: FXN; (+) strand; PAM type: YTN; PAM sequence: CTT
tctcccttgcccagcactct

SEQ ID NO: 34187 - DNA, 20 bp, Artificial Sequence
  Description of Artificial Sequence: Synthetic oligonucleotide
  Target: FXN; (+) strand; PAM type: YTN; PAM sequence: TTT
ctcccttgcccagcactctg

SEQ ID NO: 34188 - DNA, 20 bp, Artificial Sequence
  Description of Artificial Sequence: Synthetic oligonucleotide
  Target: FXN; (+) strand; PAM type: YTN; PAM sequence: TTC
tcccttgcccagcactctga

SEQ ID NO: 34189 - DNA, 20 bp, Artificial Sequence
  Description of Artificial Sequence: Synthetic oligonucleotide
  Target: FXN; (+) strand; PAM type: YTN; PAM sequence: CTC
ccttgcccagcactctgagg

SEQ ID NO: 34190 - DNA, 20 bp, Artificial Sequence
  Description of Artificial Sequence: Synthetic oligonucleotide
  Target: FXN; (+) strand; PAM type: YTN; PAM sequence: CTT
gcccagcactctgaggttga

SEQ ID NO: 34191 - DNA, 20 bp, Artificial Sequence
  Description of Artificial Sequence: Synthetic oligonucleotide
  Target: FXN; (+) strand; PAM type: YTN; PAM sequence: TTG
cccagcactctgaggttgac

SEQ ID NO: 34192 - DNA, 20 bp, Artificial Sequence
  Description of Artificial Sequence: Synthetic oligonucleotide
  Target: FXN; (+) strand; PAM type: YTN; PAM sequence: CTC
tgaggttgactctgtggagc

SEQ ID NO: 34193 - DNA, 20 bp, Artificial Sequence
  Description of Artificial Sequence: Synthetic oligonucleotide
  Target: FXN; (+) strand; PAM type: YTN; PAM sequence: CTG
aggttgactctgtggagcac

SEQ ID NO: 34194 - DNA, 20 bp, Artificial Sequence
  Description of Artificial Sequence: Synthetic oligonucleotide
  Target: FXN; (+) strand; PAM type: YTN; PAM sequence: TTG
actctgtggagcactgatcc

SEQ ID NO: 34195 - DNA, 20 bp, Artificial Sequence
  Description of Artificial Sequence: Synthetic oligonucleotide
  Target: FXN; (+) strand; PAM type: YTN; PAM sequence: CTC
tgtggagcactgatccctct

SEQ ID NO: 34196 - DNA, 20 bp, Artificial Sequence
  Description of Artificial Sequence: Synthetic oligonucleotide
  Target: FXN; (+) strand; PAM type: YTN; PAM sequence: CTG
tggagcactgatccctctgt

SEQ ID NO: 34197 - DNA, 20 bp, Artificial Sequence
  Description of Artificial Sequence: Synthetic oligonucleotide
  Target: FXN; (+) strand; PAM type: YTN; PAM sequence: CTG
atccctctgtgttataattg

SEQ ID NO: 34198 - DNA, 20 bp, Artificial Sequence
  Description of Artificial Sequence: Synthetic oligonucleotide
  Target: FXN; (+) strand; PAM type: YTN; PAM sequence: CTC
tgtgttataattgtctattt

SEQ ID NO: 34199 - DNA, 20 bp, Artificial Sequence
  Description of Artificial Sequence: Synthetic oligonucleotide
  Target: FXN; (+) strand; PAM type: YTN; PAM sequence: CTG
tgttataattgtctatttac

SEQ ID NO: 34200 - DNA, 20 bp, Artificial Sequence
  Description of Artificial Sequence: Synthetic oligonucleotide
  Target: FXN; (+) strand; PAM type: YTN; PAM sequence: TTA
taattgtctatttacacgtc

SEQ ID NO: 34201 - DNA, 20 bp, Artificial Sequence
  Description of Artificial Sequence: Synthetic oligonucleotide
  Target: FXN; (+) strand; PAM type: YTN; PAM sequence: TTG
tctatttacacgtcagctac

SEQ ID NO: 34202 - DNA, 20 bp, Artificial Sequence
  Description of Artificial Sequence: Synthetic oligonucleotide
  Target: FXN; (+) strand; PAM type: YTN; PAM sequence: CTA
tttacacgtcagctaccacc

SEQ ID NO: 34203 - DNA, 20 bp, Artificial Sequence
  Description of Artificial Sequence: Synthetic oligonucleotide
  Target: FXN; (+) strand; PAM type: YTN; PAM sequence: TTT
acacgtcagctaccacctat

SEQ ID NO: 34204 - DNA, 20 bp, Artificial Sequence
  Description of Artificial Sequence: Synthetic oligonucleotide
  Target: FXN; (+) strand; PAM type: YTN; PAM sequence: TTA
cacgtcagctaccacctata

SEQ ID NO: 34205 - DNA, 20 bp, Artificial Sequence
  Description of Artificial Sequence: Synthetic oligonucleotide
  Target: FXN; (+) strand; PAM type: YTN; PAM sequence: CTA
ccacctataacacactgagt

SEQ ID NO: 34206 - DNA, 20 bp, Artificial Sequence
  Description of Artificial Sequence: Synthetic oligonucleotide
  Target: FXN; (+) strand; PAM type: YTN; PAM sequence: CTA
taacacactgagttcctcaa

SEQ ID NO: 34207 - DNA, 20 bp, Artificial Sequence
  Description of Artificial Sequence: Synthetic oligonucleotide
  Target: FXN; (+) strand; PAM type: YTN; PAM sequence: CTG
agttcctcaacagcagggac

SEQ ID NO: 34208 - DNA, 20 bp, Artificial Sequence
  Description of Artificial Sequence: Synthetic oligonucleotide
  Target: FXN; (+) strand; PAM type: YTN; PAM sequence: TTC
ctcaacagcagggacactgt

SEQ ID NO: 34209 - DNA, 20 bp, Artificial Sequence
  Description of Artificial Sequence: Synthetic oligonucleotide
  Target: FXN; (+) strand; PAM type: YTN; PAM sequence: CTC
aacagcagggacactgtcca

SEQ ID NO: 34210 - DNA, 20 bp, Artificial Sequence
  Description of Artificial Sequence: Synthetic oligonucleotide
  Target: FXN; (+) strand; PAM type: YTN; PAM sequence: CTG
tccattctttgatcccagtg

SEQ ID NO: 34211 - DNA, 20 bp, Artificial Sequence
  Description of Artificial Sequence: Synthetic oligonucleotide
  Target: FXN; (+) strand; PAM type: YTN; PAM sequence: TTC
tttgatcccagtgtctggaa

SEQ ID NO: 34212 - DNA, 20 bp, Artificial Sequence
  Description of Artificial Sequence: Synthetic oligonucleotide
  Target: FXN; (+) strand; PAM type: YTN; PAM sequence: CTT
tgatcccagtgtctggaaca

SEQ ID NO: 34213 - DNA, 20 bp, Artificial Sequence
  Description of Artificial Sequence: Synthetic oligonucleotide
  Target: FXN; (+) strand; PAM type: YTN; PAM sequence: TTT
gatcccagtgtctggaacag

SEQ ID NO: 34214 - DNA, 20 bp, Artificial Sequence
  Description of Artificial Sequence: Synthetic oligonucleotide
  Target: FXN; (+) strand; PAM type: YTN; PAM sequence: TTG
atcccagtgtctggaacagt

SEQ ID NO: 34215 - DNA, 20 bp, Artificial Sequence
  Description of Artificial Sequence: Synthetic oligonucleotide
  Target: FXN; (+) strand; PAM type: YTN; PAM sequence: CTG
gaacagtgccaagtacatag

SEQ ID NO: 34216 - DNA, 20 bp, Artificial Sequence
  Description of Artificial Sequence: Synthetic oligonucleotide
  Target: FXN; (+) strand; PAM type: YTN; PAM sequence: CTT
aataaatattgattcatatg

SEQ ID NO: 34217 - DNA, 20 bp, Artificial Sequence
  Description of Artificial Sequence: Synthetic oligonucleotide
  Target: FXN; (+) strand; PAM type: YTN; PAM sequence: TTA
ataaatattgattcatatgt

SEQ ID NO: 34218 - DNA, 20 bp, Artificial Sequence
  Description of Artificial Sequence: Synthetic oligonucleotide
  Target: FXN; (+) strand; PAM type: YTN; PAM sequence: TTG
attcatatgtaaatgagact

SEQ ID NO: 34219 - DNA, 20 bp, Artificial Sequence
  Description of Artificial Sequence: Synthetic oligonucleotide
  Target: FXN; (+) strand; PAM type: YTN; PAM sequence: TTC
atatgtaaatgagacttttc

SEQ ID NO: 34220 - DNA, 20 bp, Artificial Sequence
  Description of Artificial Sequence: Synthetic oligonucleotide
  Target: FXN; (+) strand; PAM type: YTN; PAM sequence: CTT
ttccaaaacatgctttcgtt

SEQ ID NO: 34221 - DNA, 20 bp, Artificial Sequence
  Description of Artificial Sequence: Synthetic oligonucleotide
  Target: FXN; (+) strand; PAM type: YTN; PAM sequence: TTT
tccaaaacatgctttcgttg

SEQ ID NO: 34222 - DNA, 20 bp, Artificial Sequence
  Description of Artificial Sequence: Synthetic oligonucleotide
  Target: FXN; (+) strand; PAM type: YTN; PAM sequence: TTT
ccaaaacatgctttcgttga

SEQ ID NO: 34223 - DNA, 20 bp, Artificial Sequence
  Description of Artificial Sequence: Synthetic oligonucleotide
  Target: FXN; (+) strand; PAM type: YTN; PAM sequence: TTC
caaaacatgctttcgttgat

SEQ ID NO: 34224 - DNA, 20 bp, Artificial Sequence
  Description of Artificial Sequence: Synthetic oligonucleotide
  Target: FXN; (+) strand; PAM type: YTN; PAM sequence: CTT
tcgttgatgcctctcagcat

SEQ ID NO: 34225 - DNA, 20 bp, Artificial Sequence
  Description of Artificial Sequence: Synthetic oligonucleotide
  Target: FXN; (+) strand; PAM type: YTN; PAM sequence: TTT
cgttgatgcctctcagcatt

SEQ ID NO: 34226 - DNA, 20 bp, Artificial Sequence
  Description of Artificial Sequence: Synthetic oligonucleotide
  Target: FXN; (+) strand; PAM type: YTN; PAM sequence: TTC
gttgatgcctctcagcattt

SEQ ID NO: 34227 - DNA, 20 bp, Artificial Sequence
  Description of Artificial Sequence: Synthetic oligonucleotide
  Target: FXN; (+) strand; PAM type: YTN; PAM sequence: TTG
atgcctctcagcatttatac

SEQ ID NO: 34228 - DNA, 20 bp, Artificial Sequence
  Description of Artificial Sequence: Synthetic oligonucleotide
  Target: FXN; (+) strand; PAM type: YTN; PAM sequence: CTC
tcagcatttatacacctttt

SEQ ID NO: 34229 - DNA, 20 bp, Artificial Sequence
  Description of Artificial Sequence: Synthetic oligonucleotide
  Target: FXN; (+) strand; PAM type: YTN; PAM sequence: CTC
agcatttatacaccttttac

SEQ ID NO: 34230 - DNA, 20 bp, Artificial Sequence
  Description of Artificial Sequence: Synthetic oligonucleotide
  Target: FXN; (+) strand; PAM type: YTN; PAM sequence: TTT
atacaccttttaccaactcg

SEQ ID NO: 34231 - DNA, 20 bp, Artificial Sequence
  Description of Artificial Sequence: Synthetic oligonucleotide
  Target: FXN; (+) strand; PAM type: YTN; PAM sequence: TTA
tacaccttttaccaactcgc

SEQ ID NO: 34232 - DNA, 20 bp, Artificial Sequence
  Description of Artificial Sequence: Synthetic oligonucleotide
  Target: FXN; (+) strand; PAM type: YTN; PAM sequence: CTT
ttaccaactcgctactggcc

SEQ ID NO: 34233 - DNA, 20 bp, Artificial Sequence
  Description of Artificial Sequence: Synthetic oligonucleotide
  Target: FXN; (+) strand; PAM type: YTN; PAM sequence: TTT
taccaactcgctactggcca

SEQ ID NO: 34234 - DNA, 20 bp, Artificial Sequence
  Description of Artificial Sequence: Synthetic oligonucleotide
  Target: FXN; (+) strand; PAM type: YTN; PAM sequence: TTT
accaactcgctactggccac

SEQ ID NO: 34235 - DNA, 20 bp, Artificial Sequence
  Description of Artificial Sequence: Synthetic oligonucleotide
  Target: FXN; (+) strand; PAM type: YTN; PAM sequence: TTA
ccaactcgctactggccaca

SEQ ID NO: 34236 - DNA, 20 bp, Artificial Sequence
  Description of Artificial Sequence: Synthetic oligonucleotide
  Target: FXN; (+) strand; PAM type: YTN; PAM sequence: CTC
gctactggccacatagacaa

SEQ ID NO: 34237 - DNA, 20 bp, Artificial Sequence
  Description of Artificial Sequence: Synthetic oligonucleotide
  Target: FXN; (+) strand; PAM type: YTN; PAM sequence: CTA
ctggccacatagacaaatga

SEQ ID NO: 34238 - DNA, 20 bp, Artificial Sequence
  Description of Artificial Sequence: Synthetic oligonucleotide
  Target: FXN; (+) strand; PAM type: YTN; PAM sequence: CTG
gccacatagacaaatgaaag

SEQ ID NO: 34239 - DNA, 20 bp, Artificial Sequence
  Description of Artificial Sequence: Synthetic oligonucleotide
  Target: FXN; (+) strand; PAM type: YTN; PAM sequence: CTG
ttcttttttctctctgtgga

SEQ ID NO: 34240 - DNA, 20 bp, Artificial Sequence
  Description of Artificial Sequence: Synthetic oligonucleotide
  Target: FXN; (+) strand; PAM type: YTN; PAM sequence: TTC
ttttttctctctgtggagtg

SEQ ID NO: 34241 - DNA, 20 bp, Artificial Sequence
  Description of Artificial Sequence: Synthetic oligonucleotide
  Target: FXN; (+) strand; PAM type: YTN; PAM sequence: CTT
ttttctctctgtggagtggg

SEQ ID NO: 34242 - DNA, 20 bp, Artificial Sequence
  Description of Artificial Sequence: Synthetic oligonucleotide
  Target: FXN; (+) strand; PAM type: YTN; PAM sequence: TTT
tttctctctgtggagtggga

SEQ ID NO: 34243 - DNA, 20 bp, Artificial Sequence
  Description of Artificial Sequence: Synthetic oligonucleotide
  Target: FXN; (+) strand; PAM type: YTN; PAM sequence: TTT
ttctctctgtggagtgggag

SEQ ID NO: 34244 - DNA, 20 bp, Artificial Sequence
  Description of Artificial Sequence: Synthetic oligonucleotide
  Target: FXN; (+) strand; PAM type: YTN; PAM sequence: TTT
tctctctgtggagtgggaga

SEQ ID NO: 34245 - DNA, 20 bp, Artificial Sequence
  Description of Artificial Sequence: Synthetic oligonucleotide
  Target: FXN; (+) strand; PAM type: YTN; PAM sequence: TTT
ctctctgtggagtgggagac

SEQ ID NO: 34246 - DNA, 20 bp, Artificial Sequence
  Description of Artificial Sequence: Synthetic oligonucleotide
  Target: FXN; (+) strand; PAM type: YTN; PAM sequence: TTC
tctctgtggagtgggagact

SEQ ID NO: 34247 - DNA, 20 bp, Artificial Sequence
  Description of Artificial Sequence: Synthetic oligonucleotide
  Target: FXN; (+) strand; PAM type: YTN; PAM sequence: CTC
tctgtggagtgggagactta

SEQ ID NO: 34248 - DNA, 20 bp, Artificial Sequence
  Description of Artificial Sequence: Synthetic oligonucleotide
  Target: FXN; (+) strand; PAM type: YTN; PAM sequence: CTC
tgtggagtgggagacttaag

SEQ ID NO: 34249 - DNA, 20 bp, Artificial Sequence
  Description of Artificial Sequence: Synthetic oligonucleotide
  Target: FXN; (+) strand; PAM type: YTN; PAM sequence: CTG
tggagtgggagacttaagtg

SEQ ID NO: 34250 - DNA, 20 bp, Artificial Sequence
  Description of Artificial Sequence: Synthetic oligonucleotide
  Target: FXN; (+) strand; PAM type: YTN; PAM sequence: CTT
aagtggcttcttaactggtg

SEQ ID NO: 34251 - DNA, 20 bp, Artificial Sequence
  Description of Artificial Sequence: Synthetic oligonucleotide
  Target: FXN; (+) strand; PAM type: YTN; PAM sequence: TTA
agtggcttcttaactggtgt

SEQ ID NO: 34252 - DNA, 20 bp, Artificial Sequence
  Description of Artificial Sequence: Synthetic oligonucleotide
  Target: FXN; (+) strand; PAM type: YTN; PAM sequence: CTT
cttaactggtgtgtcgtctg

SEQ ID NO: 34253 - DNA, 20 bp, Artificial Sequence
  Description of Artificial Sequence: Synthetic oligonucleotide
  Target: FXN; (+) strand; PAM type: YTN; PAM sequence: TTC
ttaactggtgtgtcgtctga

SEQ ID NO: 34254 - DNA, 20 bp, Artificial Sequence
  Description of Artificial Sequence: Synthetic oligonucleotide
  Target: FXN; (+) strand; PAM type: YTN; PAM sequence: CTT
aactggtgtgtcgtctgatc

SEQ ID NO: 34255 - DNA, 20 bp, Artificial Sequence
  Description of Artificial Sequence: Synthetic oligonucleotide
  Target: FXN; (+) strand; PAM type: YTN; PAM sequence: TTA
actggtgtgtcgtctgatca

SEQ ID NO: 34256 - DNA, 20 bp, Artificial Sequence
  Description of Artificial Sequence: Synthetic oligonucleotide
  Target: FXN; (+) strand; PAM type: YTN; PAM sequence: CTG
gtgtgtcgtctgatcaagtg

SEQ ID NO: 34257 - DNA, 20 bp, Artificial Sequence
  Description of Artificial Sequence: Synthetic oligonucleotide
  Target: FXN; (+) strand; PAM type: YTN; PAM sequence: CTG
atcaagtggtccaggtaaca

SEQ ID NO: 34258 - DNA, 20 bp, Artificial Sequence
  Description of Artificial Sequence: Synthetic oligonucleotide
  Target: FXN; (+) strand; PAM type: YTN; PAM sequence: CTG
gcccaggcatcaccccttac

SEQ ID NO: 34259 - DNA, 20 bp, Artificial Sequence
  Description of Artificial Sequence: Synthetic oligonucleotide
  Target: FXN; (+) strand; PAM type: YTN; PAM sequence: CTT
actggcactggtcattacag

SEQ ID NO: 34260 - DNA, 20 bp, Artificial Sequence
  Description of Artificial Sequence: Synthetic oligonucleotide
  Target: FXN; (+) strand; PAM type: YTN; PAM sequence: TTA
ctggcactggtcattacaga

SEQ ID NO: 34261 - DNA, 20 bp, Artificial Sequence
  Description of Artificial Sequence: Synthetic oligonucleotide
  Target: FXN; (+) strand; PAM type: YTN; PAM sequence: CTG
gcactggtcattacagaaga

SEQ ID NO: 34262 - DNA, 20 bp, Artificial Sequence
  Description of Artificial Sequence: Synthetic oligonucleotide
  Target: FXN; (+) strand; PAM type: YTN; PAM sequence: CTG
gtcattacagaagacactct

SEQ ID NO: 34263 - DNA, 20 bp, Artificial Sequence
  Description of Artificial Sequence: Synthetic oligonucleotide
  Target: FXN; (+) strand; PAM type: YTN; PAM sequence: TTA
cagaagacactctaccagag

SEQ ID NO: 34264 - DNA, 20 bp, Artificial Sequence
  Description of Artificial Sequence: Synthetic oligonucleotide
  Target: FXN; (+) strand; PAM type: YTN; PAM sequence: CTC
taccagagctgaaaggacct

SEQ ID NO: 34265 - DNA, 20 bp, Artificial Sequence
  Description of Artificial Sequence: Synthetic oligonucleotide
  Target: FXN; (+) strand; PAM type: YTN; PAM sequence: CTA
ccagagctgaaaggacctct

SEQ ID NO: 34266 - DNA, 20 bp, Artificial Sequence
  Description of Artificial Sequence: Synthetic oligonucleotide
  Target: FXN; (+) strand; PAM type: YTN; PAM sequence: CTG
aaaggacctcttgtcactag

SEQ ID NO: 34267 - DNA, 20 bp, Artificial Sequence
  Description of Artificial Sequence: Synthetic oligonucleotide
  Target: FXN; (+) strand; PAM type: YTN; PAM sequence: CTC
ttgtcactaggcagctgtgg

SEQ ID NO: 34268 - DNA, 20 bp, Artificial Sequence
  Description of Artificial Sequence: Synthetic oligonucleotide
  Target: FXN; (+) strand; PAM type: YTN; PAM sequence: CTT
gtcactaggcagctgtggag

SEQ ID NO: 34269 - DNA, 20 bp, Artificial Sequence
  Description of Artificial Sequence: Synthetic oligonucleotide
  Target: FXN; (+) strand; PAM type: YTN; PAM sequence: TTG
tcactaggcagctgtggagt

SEQ ID NO: 34270 - DNA, 20 bp, Artificial Sequence
  Description of Artificial Sequence: Synthetic oligonucleotide
  Target: FXN; (+) strand; PAM type: YTN; PAM sequence: CTA
ggcagctgtggagtccgctc

SEQ ID NO: 34271 - DNA, 20 bp, Artificial Sequence
  Description of Artificial Sequence: Synthetic oligonucleotide
  Target: FXN; (+) strand; PAM type: YTN; PAM sequence: CTG
tggagtccgctctacttgac

SEQ ID NO: 34272 - DNA, 20 bp, Artificial Sequence
  Description of Artificial Sequence: Synthetic oligonucleotide
  Target: FXN; (+) strand; PAM type: YTN; PAM sequence: CTC
tacttgacctagtaaaatct

SEQ ID NO: 34273 - DNA, 20 bp, Artificial Sequence
  Description of Artificial Sequence: Synthetic oligonucleotide
  Target: FXN; (+) strand; PAM type: YTN; PAM sequence: CTA
cttgacctagtaaaatctgc

SEQ ID NO: 34274 - DNA, 20 bp, Artificial Sequence
  Description of Artificial Sequence: Synthetic oligonucleotide
  Target: FXN; (+) strand; PAM type: YTN; PAM sequence: CTT
gacctagtaaaatctgcctg

SEQ ID NO: 34275 - DNA, 20 bp, Artificial Sequence
  Description of Artificial Sequence: Synthetic oligonucleotide
  Target: FXN; (+) strand; PAM type: YTN; PAM sequence: TTG
acctagtaaaatctgcctgg

SEQ ID NO: 34276 - DNA, 20 bp, Artificial Sequence
  Description of Artificial Sequence: Synthetic oligonucleotide
  Target: FXN; (+) strand; PAM type: YTN; PAM sequence: CTA
gtaaaatctgcctggagact

SEQ ID NO: 34277 - DNA, 20 bp, Artificial Sequence
  Description of Artificial Sequence: Synthetic oligonucleotide
  Target: FXN; (+) strand; PAM type: YTN; PAM sequence: CTG
cctggagactgttagagtca

SEQ ID NO: 34278 - DNA, 20 bp, Artificial Sequence
  Description of Artificial Sequence: Synthetic oligonucleotide
  Target: FXN; (+) strand; PAM type: YTN; PAM sequence: CTG
gagactgttagagtcacccc

SEQ ID NO: 34279 - DNA, 20 bp, Artificial Sequence
  Description of Artificial Sequence: Synthetic oligonucleotide
  Target: FXN; (+) strand; PAM type: YTN; PAM sequence: CTG
ttagagtcaccccactacct

SEQ ID NO: 34280 - DNA, 20 bp, Artificial Sequence
  Description of Artificial Sequence: Synthetic oligonucleotide
  Target: FXN; (+) strand; PAM type: YTN; PAM sequence: TTA
gagtcaccccactacctgaa

SEQ ID NO: 34281 - DNA, 20 bp, Artificial Sequence
  Description of Artificial Sequence: Synthetic oligonucleotide
  Target: FXN; (+) strand; PAM type: YTN; PAM sequence: CTA
cctgaagttacctccaggct

SEQ ID NO: 34282 - DNA, 20 bp, Artificial Sequence
  Description of Artificial Sequence: Synthetic oligonucleotide
  Target: FXN; (+) strand; PAM type: YTN; PAM sequence: CTG
aagttacctccaggctgacc

SEQ ID NO: 34283 - DNA, 20 bp, Artificial Sequence
  Description of Artificial Sequence: Synthetic oligonucleotide
  Target: FXN; (+) strand; PAM type: YTN; PAM sequence: TTA
cctccaggctgacctctttt

SEQ ID NO: 34284 - DNA, 20 bp, Artificial Sequence
  Description of Artificial Sequence: Synthetic oligonucleotide
  Target: FXN; (+) strand; PAM type: YTN; PAM sequence: CTC
caggctgacctctttttttt

SEQ ID NO: 34285 - DNA, 20 bp, Artificial Sequence
  Description of Artificial Sequence: Synthetic oligonucleotide
  Target: FXN; (+) strand; PAM type: YTN; PAM sequence: CTG
acctcttttttttcccaggt

SEQ ID NO: 34286 - DNA, 20 bp, Artificial Sequence
  Description of Artificial Sequence: Synthetic oligonucleotide
  Target: FXN; (+) strand; PAM type: YTN; PAM sequence: CTC
ttttttttcccaggtggagt

SEQ ID NO: 34287 - DNA, 20 bp, Artificial Sequence
  Description of Artificial Sequence: Synthetic oligonucleotide
  Target: FXN; (+) strand; PAM type: YTN; PAM sequence: CTT
ttttttcccaggtggagtcc

SEQ ID NO: 34288 - DNA, 20 bp, Artificial Sequence
  Description of Artificial Sequence: Synthetic oligonucleotide
  Target: FXN; (+) strand; PAM type: YTN; PAM sequence: TTT
tttttcccaggtggagtcct

SEQ ID NO: 34289 - DNA, 20 bp, Artificial Sequence
  Description of Artificial Sequence: Synthetic oligonucleotide
  Target: FXN; (+) strand; PAM type: YTN; PAM sequence: TTT
ttttcccaggtggagtcctg

SEQ ID NO: 34290 - DNA, 20 bp, Artificial Sequence
  Description of Artificial Sequence: Synthetic oligonucleotide
  Target: FXN; (+) strand; PAM type: YTN; PAM sequence: TTT
tttcccaggtggagtcctgg

SEQ ID NO: 34291 - DNA, 20 bp, Artificial Sequence
  Description of Artificial Sequence: Synthetic oligonucleotide
  Target: FXN; (+) strand; PAM type: YTN; PAM sequence: TTT
ttcccaggtggagtcctggc

SEQ ID NO: 34292 - DNA, 20 bp, Artificial Sequence
  Description of Artificial Sequence: Synthetic oligonucleotide
  Target: FXN; (+) strand; PAM type: YTN; PAM sequence: TTT
tcccaggtggagtcctggca

SEQ ID NO: 34293 - DNA, 20 bp, Artificial Sequence
  Description of Artificial Sequence: Synthetic oligonucleotide
  Target: FXN; (+) strand; PAM type: YTN; PAM sequence: TTT
cccaggtggagtcctggcat

SEQ ID NO: 34294 - DNA, 20 bp, Artificial Sequence
  Description of Artificial Sequence: Synthetic oligonucleotide
  Target: FXN; (+) strand; PAM type: YTN; PAM sequence: TTC
ccaggtggagtcctggcatc

SEQ ID NO: 34295 - DNA, 20 bp, Artificial Sequence
  Description of Artificial Sequence: Synthetic oligonucleotide
  Target: FXN; (+) strand; PAM type: YTN; PAM sequence: CTG
gcatcttagatattttaata

SEQ ID NO: 34296 - DNA, 20 bp, Artificial Sequence
  Description of Artificial Sequence: Synthetic oligonucleotide
  Target: FXN; (+) strand; PAM type: YTN; PAM sequence: CTT
agatattttaataaggattt

SEQ ID NO: 34297 - DNA, 20 bp, Artificial Sequence
  Description of Artificial Sequence: Synthetic oligonucleotide
  Target: FXN; (+) strand; PAM type: YTN; PAM sequence: TTA
gatattttaataaggatttg

SEQ ID NO: 34298 - DNA, 20 bp, Artificial Sequence
  Description of Artificial Sequence: Synthetic oligonucleotide
  Target: FXN; (+) strand; PAM type: YTN; PAM sequence: TTT
taataaggatttgcttgttg

SEQ ID NO: 34299 - DNA, 20 bp, Artificial Sequence
  Description of Artificial Sequence: Synthetic oligonucleotide
  Target: FXN; (+) strand; PAM type: YTN; PAM sequence: TTT
aataaggatttgcttgttga

SEQ ID NO: 34300 - DNA, 20 bp, Artificial Sequence
  Description of Artificial Sequence: Synthetic oligonucleotide
  Target: FXN; (+) strand; PAM type: YTN; PAM sequence: TTA
ataaggatttgcttgttgac

SEQ ID NO: 34301 - DNA, 20 bp, Artificial Sequence
  Description of Artificial Sequence: Synthetic oligonucleotide
  Target: FXN; (+) strand; PAM type: YTN; PAM sequence: TTT
gcttgttgacatgttcttta

SEQ ID NO: 34302 - DNA, 20 bp, Artificial Sequence
  Description of Artificial Sequence: Synthetic oligonucleotide
  Target: FXN; (+) strand; PAM type: YTN; PAM sequence: TTG
cttgttgacatgttctttat

SEQ ID NO: 34303 - DNA, 20 bp, Artificial Sequence
  Description of Artificial Sequence: Synthetic oligonucleotide
  Target: FXN; (+) strand; PAM type: YTN; PAM sequence: CTT
gttgacatgttctttattca

SEQ ID NO: 34304 - DNA, 20 bp, Artificial Sequence
  Description of Artificial Sequence: Synthetic oligonucleotide
  Target: FXN; (+) strand; PAM type: YTN; PAM sequence: TTG
ttgacatgttctttattcac

SEQ ID NO: 34305 - DNA, 20 bp, Artificial Sequence
  Description of Artificial Sequence: Synthetic oligonucleotide
  Target: FXN; (+) strand; PAM type: YTN; PAM sequence: TTG
acatgttctttattcactaa

SEQ ID NO: 34306 - DNA, 20 bp, Artificial Sequence
  Description of Artificial Sequence: Synthetic oligonucleotide
  Target: FXN; (+) strand; PAM type: YTN; PAM sequence: TTC
tttattcactaaggtgtcag

SEQ ID NO: 34307 - DNA, 20 bp, Artificial Sequence
  Description of Artificial Sequence: Synthetic oligonucleotide
  Target: FXN; (+) strand; PAM type: YTN; PAM sequence: CTT
tattcactaaggtgtcagca

SEQ ID NO: 34308 - DNA, 20 bp, Artificial Sequence
  Description of Artificial Sequence: Synthetic oligonucleotide
  Target: FXN; (+) strand; PAM type: YTN; PAM sequence: TTT
attcactaaggtgtcagcat

SEQ ID NO: 34309 - DNA, 20 bp, Artificial Sequence
  Description of Artificial Sequence: Synthetic oligonucleotide
  Target: FXN; (+) strand; PAM type: YTN; PAM sequence: TTA
ttcactaaggtgtcagcata

SEQ ID NO: 34310 - DNA, 20 bp, Artificial Sequence
  Description of Artificial Sequence: Synthetic oligonucleotide
  Target: FXN; (+) strand; PAM type: YTN; PAM sequence: TTC
actaaggtgtcagcatatta

SEQ ID NO: 34311 - DNA, 20 bp, Artificial Sequence
  Description of Artificial Sequence: Synthetic oligonucleotide
  Target: FXN; (+) strand; PAM type: YTN; PAM sequence: CTA
aggtgtcagcatattactgt

SEQ ID NO: 34312 - DNA, 20 bp, Artificial Sequence
  Description of Artificial Sequence: Synthetic oligonucleotide
  Target: FXN; (+) strand; PAM type: YTN; PAM sequence: TTA
ctgtcttagaactgagggtt

SEQ ID NO: 34313 - DNA, 20 bp, Artificial Sequence
  Description of Artificial Sequence: Synthetic oligonucleotide
  Target: FXN; (+) strand; PAM type: YTN; PAM sequence: CTG
tcttagaactgagggttctt

SEQ ID NO: 34314 - DNA, 20 bp, Artificial Sequence
  Description of Artificial Sequence: Synthetic oligonucleotide
  Target: FXN; (+) strand; PAM type: YTN; PAM sequence: CTT
agaactgagggttcttcatc

SEQ ID NO: 34315 - DNA, 20 bp, Artificial Sequence
  Description of Artificial Sequence: Synthetic oligonucleotide
  Target: FXN; (+) strand; PAM type: YTN; PAM sequence: TTA
gaactgagggttcttcatct

SEQ ID NO: 34316 - DNA, 20 bp, Artificial Sequence
  Description of Artificial Sequence: Synthetic oligonucleotide
  Target: FXN; (+) strand; PAM type: YTN; PAM sequence: CTG
agggttcttcatcttttttg

SEQ ID NO: 34317 - DNA, 20 bp, Artificial Sequence
  Description of Artificial Sequence: Synthetic oligonucleotide
  Target: FXN; (+) strand; PAM type: YTN; PAM sequence: TTC
ttcatcttttttggatcagg

SEQ ID NO: 34318 - DNA, 20 bp, Artificial Sequence
  Description of Artificial Sequence: Synthetic oligonucleotide
  Target: FXN; (+) strand; PAM type: YTN; PAM sequence: CTT
catcttttttggatcaggac

SEQ ID NO: 34319 - DNA, 20 bp, Artificial Sequence
  Description of Artificial Sequence: Synthetic oligonucleotide
  Target: FXN; (+) strand; PAM type: YTN; PAM sequence: TTC
atcttttttggatcaggacc

SEQ ID NO: 34320 - DNA, 20 bp, Artificial Sequence
  Description of Artificial Sequence: Synthetic oligonucleotide
  Target: FXN; (+) strand; PAM type: YTN; PAM sequence: CTT
ttttggatcaggacctccct

SEQ ID NO: 34321 - DNA, 20 bp, Artificial Sequence
  Description of Artificial Sequence: Synthetic oligonucleotide
  Target: FXN; (+) strand; PAM type: YTN; PAM sequence: TTT
tttggatcaggacctccctc

SEQ ID NO: 34322 - DNA, 20 bp, Artificial Sequence
  Description of Artificial Sequence: Synthetic oligonucleotide
  Target: FXN; (+) strand; PAM type: YTN; PAM sequence: TTT
ttggatcaggacctccctct

SEQ ID NO: 34323 - DNA, 20 bp, Artificial Sequence
  Description of Artificial Sequence: Synthetic oligonucleotide
  Target: FXN; (+) strand; PAM type: YTN; PAM sequence: TTT
tggatcaggacctccctcta

SEQ ID NO: 34324 - DNA, 20 bp, Artificial Sequence
  Description of Artificial Sequence: Synthetic oligonucleotide
  Target: FXN; (+) strand; PAM type: YTN; PAM sequence: TTT
ggatcaggacctccctctaa

SEQ ID NO: 34325 - DNA, 20 bp, Artificial Sequence
  Description of Artificial Sequence: Synthetic oligonucleotide
  Target: FXN; (+) strand; PAM type: YTN; PAM sequence: TTG
gatcaggacctccctctaag

SEQ ID NO: 34326 - DNA, 20 bp, Artificial Sequence
  Description of Artificial Sequence: Synthetic oligonucleotide
  Target: FXN; (+) strand; PAM type: YTN; PAM sequence: CTC
cctctaagaatctgatgact

SEQ ID NO: 34327 - DNA, 20 bp, Artificial Sequence
  Description of Artificial Sequence: Synthetic oligonucleotide
  Target: FXN; (+) strand; PAM type: YTN; PAM sequence: CTC
taagaatctgatgactgctc

SEQ ID NO: 34328 - DNA, 20 bp, Artificial Sequence
  Description of Artificial Sequence: Synthetic oligonucleotide
  Target: FXN; (+) strand; PAM type: YTN; PAM sequence: CTA
agaatctgatgactgctctg

SEQ ID NO: 34329 - DNA, 20 bp, Artificial Sequence
  Description of Artificial Sequence: Synthetic oligonucleotide
  Target: FXN; (+) strand; PAM type: YTN; PAM sequence: CTG
atgactgctctggtccctct

SEQ ID NO: 34330 - DNA, 20 bp, Artificial Sequence
  Description of Artificial Sequence: Synthetic oligonucleotide
  Target: FXN; (+) strand; PAM type: YTN; PAM sequence: CTG
ctctggtccctctcccaata

SEQ ID NO: 34331 - DNA, 20 bp, Artificial Sequence
  Description of Artificial Sequence: Synthetic oligonucleotide
  Target: FXN; (+) strand; PAM type: YTN; PAM sequence: CTC
tggtccctctcccaataaaa

SEQ ID NO: 34332 - DNA, 20 bp, Artificial Sequence
  Description of Artificial Sequence: Synthetic oligonucleotide
  Target: FXN; (+) strand; PAM type: YTN; PAM sequence: CTG
gtccctctcccaataaaaac

SEQ ID NO: 34333 - DNA, 20 bp, Artificial Sequence
  Description of Artificial Sequence: Synthetic oligonucleotide
  Target: FXN; (+) strand; PAM type: YTN; PAM sequence: CTC
tcccaataaaaacttccata

SEQ ID NO: 34334 - DNA, 20 bp, Artificial Sequence
  Description of Artificial Sequence: Synthetic oligonucleotide
  Target: FXN; (+) strand; PAM type: YTN; PAM sequence: CTC
ccaataaaaacttccatact

SEQ ID NO: 34335 - DNA, 20 bp, Artificial Sequence
  Description of Artificial Sequence: Synthetic oligonucleotide
  Target: FXN; (+) strand; PAM type: YTN; PAM sequence: CTT
ccatactcacctgttaaaaa

SEQ ID NO: 34336 - DNA, 20 bp, Artificial Sequence
  Description of Artificial Sequence: Synthetic oligonucleotide
  Target: FXN; (+) strand; PAM type: YTN; PAM sequence: TTC
catactcacctgttaaaaaa

SEQ ID NO: 34337 - DNA, 20 bp, Artificial Sequence
  Description of Artificial Sequence: Synthetic oligonucleotide
  Target: FXN; (+) strand; PAM type: YTN; PAM sequence: CTC
acctgttaaaaaaaaaaaaa

SEQ ID NO: 34338 - DNA, 20 bp, Artificial Sequence
  Description of Artificial Sequence: Synthetic oligonucleotide
  Target: FXN; (+) strand; PAM type: YTN; PAM sequence: CTG
ttaaaaaaaaaaaaaacttt

SEQ ID NO: 34339 - DNA, 20 bp, Artificial Sequence
  Description of Artificial Sequence: Synthetic oligonucleotide
  Target: FXN; (+) strand; PAM type: YTN; PAM sequence: TTA
aaaaaaaaaaaaactttaaa

SEQ ID NO: 34340 - DNA, 20 bp, Artificial Sequence
  Description of Artificial Sequence: Synthetic oligonucleotide
  Target: FXN; (+) strand; PAM type: YTN; PAM sequence: CTT
taaacaaattaacagagttt

SEQ ID NO: 34341 - DNA, 20 bp, Artificial Sequence
  Description of Artificial Sequence: Synthetic oligonucleotide
  Target: FXN; (+) strand; PAM type: YTN; PAM sequence: TTT
aaacaaattaacagagtttt

SEQ ID NO: 34342 - DNA, 20 bp, Artificial Sequence
  Description of Artificial Sequence: Synthetic oligonucleotide
  Target: FXN; (+) strand; PAM type: YTN; PAM sequence: TTA
aacaaattaacagagtttta

SEQ ID NO: 34343 - DNA, 20 bp, Artificial Sequence
  Description of Artificial Sequence: Synthetic oligonucleotide
  Target: FXN; (+) strand; PAM type: YTN; PAM sequence: TTA
acagagttttattcagcaaa

SEQ ID NO: 34344 - DNA, 20 bp, Artificial Sequence
  Description of Artificial Sequence: Synthetic oligonucleotide
  Target: FXN; (+) strand; PAM type: YTN; PAM sequence: TTT
tattcagcaaagaatgattc

SEQ ID NO: 34345 - DNA, 20 bp, Artificial Sequence
  Description of Artificial Sequence: Synthetic oligonucleotide
  Target: FXN; (+) strand; PAM type: YTN; PAM sequence: TTT
attcagcaaagaatgattca

SEQ ID NO: 34346 - DNA, 20 bp, Artificial Sequence
  Description of Artificial Sequence: Synthetic oligonucleotide
  Target: FXN; (+) strand; PAM type: YTN; PAM sequence: TTA
ttcagcaaagaatgattcat

SEQ ID NO: 34347 - DNA, 20 bp, Artificial Sequence
  Description of Artificial Sequence: Synthetic oligonucleotide
  Target: FXN; (+) strand; PAM type: YTN; PAM sequence: TTC
agcaaagaatgattcataaa

SEQ ID NO: 34348 - DNA, 20 bp, Artificial Sequence
  Description of Artificial Sequence: Synthetic oligonucleotide
  Target: FXN; (+) strand; PAM type: YTN; PAM sequence: TTC
ataaatcgggaaggctgcaa

SEQ ID NO: 34349 - DNA, 20 bp, Artificial Sequence
  Description of Artificial Sequence: Synthetic oligonucleotide
  Target: FXN; (+) strand; PAM type: YTN; PAM sequence: CTG
caaccagaataggttcagag

SEQ ID NO: 34350 - DNA, 20 bp, Artificial Sequence
  Description of Artificial Sequence: Synthetic oligonucleotide
  Target: FXN; (+) strand; PAM type: YTN; PAM sequence: TTC
agagagactccacggtgtgc

SEQ ID NO: 34351 - DNA, 20 bp, Artificial Sequence
  Description of Artificial Sequence: Synthetic oligonucleotide
  Target: FXN; (+) strand; PAM type: YTN; PAM sequence: CTC
cacggtgtgccacgtggttg

SEQ ID NO: 34352 - DNA, 20 bp, Artificial Sequence
  Description of Artificial Sequence: Synthetic oligonucleotide
  Target: FXN; (+) strand; PAM type: YTN; PAM sequence: TTG
gagaggatttaggatttatg

SEQ ID NO: 34353 - DNA, 20 bp, Artificial Sequence
  Description of Artificial Sequence: Synthetic oligonucleotide
  Target: FXN; (+) strand; PAM type: YTN; PAM sequence: TTT
aggatttatgcacagaaaaa

SEQ ID NO: 34354 - DNA, 20 bp, Artificial Sequence
  Description of Artificial Sequence: Synthetic oligonucleotide
  Target: FXN; (+) strand; PAM type: YTN; PAM sequence: TTA
ggatttatgcacagaaaaag

SEQ ID NO: 34355 - DNA, 20 bp, Artificial Sequence
  Description of Artificial Sequence: Synthetic oligonucleotide
  Target: FXN; (+) strand; PAM type: YTN; PAM sequence: TTT
atgcacagaaaaaggaaagt

SEQ ID NO: 34356 - DNA, 20 bp, Artificial Sequence
  Description of Artificial Sequence: Synthetic oligonucleotide
  Target: FXN; (+) strand; PAM type: YTN; PAM sequence: TTA
tgcacagaaaaaggaaagtg

SEQ ID NO: 34357 - DNA, 20 bp, Artificial Sequence
  Description of Artificial Sequence: Synthetic oligonucleotide
  Target: FXN; (+) strand; PAM type: YTN; PAM sequence: CTG
gtgctggtgcggtgcctcac

SEQ ID NO: 34358 - DNA, 20 bp, Artificial Sequence
  Description of Artificial Sequence: Synthetic oligonucleotide
  Target: FXN; (+) strand; PAM type: YTN; PAM sequence: CTG
gtgcggtgcctcacgcctgt

SEQ ID NO: 34359 - DNA, 20 bp, Artificial Sequence
  Description of Artificial Sequence: Synthetic oligonucleotide
  Target: FXN; (+) strand; PAM type: YTN; PAM sequence: CTC
acgcctgtaatcccagcact

SEQ ID NO: 34360 - DNA, 20 bp, Artificial Sequence
  Description of Artificial Sequence: Synthetic oligonucleotide
  Target: FXN; (+) strand; PAM type: YTN; PAM sequence: CTG
taatcccagcactttgggag

SEQ ID NO: 34361 - DNA, 20 bp, Artificial Sequence
  Description of Artificial Sequence: Synthetic oligonucleotide
  Target: FXN; (+) strand; PAM type: YTN; PAM sequence: CTT
tgggaggccgaggcgggcag

SEQ ID NO: 34362 - DNA, 20 bp, Artificial Sequence
  Description of Artificial Sequence: Synthetic oligonucleotide
  Target: FXN; (+) strand; PAM type: YTN; PAM sequence: TTT
gggaggccgaggcgggcaga

SEQ ID NO: 34363 - DNA, 20 bp, Artificial Sequence
  Description of Artificial Sequence: Synthetic oligonucleotide
  Target: FXN; (+) strand; PAM type: YTN; PAM sequence: TTG
ggaggccgaggcgggcagat

SEQ ID NO: 34364 - DNA, 20 bp, Artificial Sequence
  Description of Artificial Sequence: Synthetic oligonucleotide
  Target: FXN; (+) strand; PAM type: YTN; PAM sequence: CTG
gctaacacggtgaaaccctg

SEQ ID NO: 34365 - DNA, 20 bp, Artificial Sequence
  Description of Artificial Sequence: Synthetic oligonucleotide
  Target: FXN; (+) strand; PAM type: YTN; PAM sequence: CTA
acacggtgaaaccctgtctc

SEQ ID NO: 34366 - DNA, 20 bp, Artificial Sequence
  Description of Artificial Sequence: Synthetic oligonucleotide
  Target: FXN; (+) strand; PAM type: YTN; PAM sequence: CTG
tctctactaaaaatgcaaaa

SEQ ID NO: 34367 - DNA, 20 bp, Artificial Sequence
  Description of Artificial Sequence: Synthetic oligonucleotide
  Target: FXN; (+) strand; PAM type: YTN; PAM sequence: CTC
tactaaaaatgcaaaaactt

SEQ ID NO: 34368 - DNA, 20 bp, Artificial Sequence
  Description of Artificial Sequence: Synthetic oligonucleotide
  Target: FXN; (+) strand; PAM type: YTN; PAM sequence: CTA
ctaaaaatgcaaaaacttag

SEQ ID NO: 34369 - DNA, 20 bp, Artificial Sequence
  Description of Artificial Sequence: Synthetic oligonucleotide
  Target: FXN; (+) strand; PAM type: YTN; PAM sequence: CTA
aaaatgcaaaaacttagccg

SEQ ID NO: 34370 - DNA, 20 bp, Artificial Sequence
  Description of Artificial Sequence: Synthetic oligonucleotide
  Target: FXN; (+) strand; PAM type: YTN; PAM sequence: CTT
agccgggcgtggtggcaggc

SEQ ID NO: 34371 - DNA, 20 bp, Artificial Sequence
  Description of Artificial Sequence: Synthetic oligonucleotide
  Target: FXN; (+) strand; PAM type: YTN; PAM sequence: TTA
gccgggcgtggtggcaggca

SEQ ID NO: 34372 - DNA, 20 bp, Artificial Sequence
  Description of Artificial Sequence: Synthetic oligonucleotide
  Target: FXN; (+) strand; PAM type: YTN; PAM sequence: CTG
tagtcccagctacttgggag

SEQ ID NO: 34373 - DNA, 20 bp, Artificial Sequence
  Description of Artificial Sequence: Synthetic oligonucleotide
  Target: FXN; (+) strand; PAM type: YTN; PAM sequence: CTA
cttgggaggctgaggcagga

SEQ ID NO: 34374 - DNA, 20 bp, Artificial Sequence
  Description of Artificial Sequence: Synthetic oligonucleotide
  Target: FXN; (+) strand; PAM type: YTN; PAM sequence: CTT
gggaggctgaggcaggagaa

SEQ ID NO: 34375 - DNA, 20 bp, Artificial Sequence
  Description of Artificial Sequence: Synthetic oligonucleotide
  Target: FXN; (+) strand; PAM type: YTN; PAM sequence: TTG
ggaggctgaggcaggagaat

SEQ ID NO: 34376 - DNA, 20 bp, Artificial Sequence
  Description of Artificial Sequence: Synthetic oligonucleotide
  Target: FXN; (+) strand; PAM type: YTN; PAM sequence: CTG
aggcaggagaatggtgtgaa

SEQ ID NO: 34377 - DNA, 20 bp, Artificial Sequence
  Description of Artificial Sequence: Synthetic oligonucleotide
  Target: FXN; (+) strand; PAM type: YTN; PAM sequence: CTG
ggaggcggagcttgcagtga

SEQ ID NO: 34378 - DNA, 20 bp, Artificial Sequence
  Description of Artificial Sequence: Synthetic oligonucleotide
  Target: FXN; (+) strand; PAM type: YTN; PAM sequence: CTT
gcagtgagccaggatcccgc

SEQ ID NO: 34379 - DNA, 20 bp, Artificial Sequence
  Description of Artificial Sequence: Synthetic oligonucleotide
  Target: FXN; (+) strand; PAM type: YTN; PAM sequence: TTG
cagtgagccaggatcccgcc

SEQ ID NO: 34380 - DNA, 20 bp, Artificial Sequence
  Description of Artificial Sequence: Synthetic oligonucleotide
  Target: FXN; (+) strand; PAM type: YTN; PAM sequence: CTG
cactccagcctgggcgacag

SEQ ID NO: 34381 - DNA, 20 bp, Artificial Sequence
  Description of Artificial Sequence: Synthetic oligonucleotide
  Target: FXN; (+) strand; PAM type: YTN; PAM sequence: CTC
cagcctgggcgacagagcga

SEQ ID NO: 34382 - DNA, 20 bp, Artificial Sequence
  Description of Artificial Sequence: Synthetic oligonucleotide
  Target: FXN; (+) strand; PAM type: YTN; PAM sequence: CTG
ggcgacagagcgagacttca

SEQ ID NO: 34383 - DNA, 20 bp, Artificial Sequence
  Description of Artificial Sequence: Synthetic oligonucleotide
  Target: FXN; (+) strand; PAM type: YTN; PAM sequence: CTT
catcttaaaaaaaaagaaaa

SEQ ID NO: 34384 - DNA, 20 bp, Artificial Sequence
  Description of Artificial Sequence: Synthetic oligonucleotide
  Target: FXN; (+) strand; PAM type: YTN; PAM sequence: TTC
atcttaaaaaaaaagaaaag

SEQ ID NO: 34385 - DNA, 20 bp, Artificial Sequence
  Description of Artificial Sequence: Synthetic oligonucleotide
  Target: FXN; (+) strand; PAM type: YTN; PAM sequence: CTT
aaaaaaaaagaaaagaaaaa

SEQ ID NO: 34386 - DNA, 20 bp, Artificial Sequence
  Description of Artificial Sequence: Synthetic oligonucleotide
  Target: FXN; (+) strand; PAM type: YTN; PAM sequence: TTA
aaaaaaaagaaaagaaaaag

SEQ ID NO: 34387 - DNA, 20 bp, Artificial Sequence
  Description of Artificial Sequence: Synthetic oligonucleotide
  Target: FXN; (+) strand; PAM type: YTN; PAM sequence: TTG
gttacagcttggtgtttgcc

SEQ ID NO: 34388 - DNA, 20 bp, Artificial Sequence
  Description of Artificial Sequence: Synthetic oligonucleotide
  Target: FXN; (+) strand; PAM type: YTN; PAM sequence: TTA
cagcttggtgtttgccttaa

SEQ ID NO: 34389 - DNA, 20 bp, Artificial Sequence
  Description of Artificial Sequence: Synthetic oligonucleotide
  Target: FXN; (+) strand; PAM type: YTN; PAM sequence: CTT
ggtgtttgccttaaacttgg

SEQ ID NO: 34390 - DNA, 20 bp, Artificial Sequence
  Description of Artificial Sequence: Synthetic oligonucleotide
  Target: FXN; (+) strand; PAM type: YTN; PAM sequence: TTG
gtgtttgccttaaacttggt

SEQ ID NO: 34391 - DNA, 20 bp, Artificial Sequence
  Description of Artificial Sequence: Synthetic oligonucleotide
  Target: FXN; (+) strand; PAM type: YTN; PAM sequence: TTT
gccttaaacttggtttgaac

SEQ ID NO: 34392 - DNA, 20 bp, Artificial Sequence
  Description of Artificial Sequence: Synthetic oligonucleotide
  Target: FXN; (+) strand; PAM type: YTN; PAM sequence: TTG
ccttaaacttggtttgaaca

SEQ ID NO: 34393 - DNA, 20 bp, Artificial Sequence
  Description of Artificial Sequence: Synthetic oligonucleotide
  Target: FXN; (+) strand; PAM type: YTN; PAM sequence: CTT
aaacttggtttgaacagttg

SEQ ID NO: 34394 - DNA, 20 bp, Artificial Sequence
  Description of Artificial Sequence: Synthetic oligonucleotide
  Target: FXN; (+) strand; PAM type: YTN; PAM sequence: TTA
aacttggtttgaacagttgg

SEQ ID NO: 34395 - DNA, 20 bp, Artificial Sequence
  Description of Artificial Sequence: Synthetic oligonucleotide
  Target: FXN; (+) strand; PAM type: YTN; PAM sequence: CTT
ggtttgaacagttggccgcc

SEQ ID NO: 34396 - DNA, 20 bp, Artificial Sequence
  Description of Artificial Sequence: Synthetic oligonucleotide
  Target: FXN; (+) strand; PAM type: YTN; PAM sequence: TTG
gtttgaacagttggccgcct

SEQ ID NO: 34397 - DNA, 20 bp, Artificial Sequence
  Description of Artificial Sequence: Synthetic oligonucleotide
  Target: FXN; (+) strand; PAM type: YTN; PAM sequence: TTT
gaacagttggccgcctttga

SEQ ID NO: 34398 - DNA, 20 bp, Artificial Sequence
  Description of Artificial Sequence: Synthetic oligonucleotide
  Target: FXN; (+) strand; PAM type: YTN; PAM sequence: TTG
aacagttggccgcctttgat

SEQ ID NO: 34399 - DNA, 20 bp, Artificial Sequence
  Description of Artificial Sequence: Synthetic oligonucleotide
  Target: FXN; (+) strand; PAM type: YTN; PAM sequence: TTG
gccgcctttgattagccaaa

SEQ ID NO: 34400 - DNA, 20 bp, Artificial Sequence
  Description of Artificial Sequence: Synthetic oligonucleotide
  Target: FXN; (+) strand; PAM type: YTN; PAM sequence: CTT
tgattagccaaaactcggtg

SEQ ID NO: 34401 - DNA, 20 bp, Artificial Sequence
  Description of Artificial Sequence: Synthetic oligonucleotide
  Target: FXN; (+) strand; PAM type: YTN; PAM sequence: TTT
gattagccaaaactcggtga

SEQ ID NO: 34402 - DNA, 20 bp, Artificial Sequence
  Description of Artificial Sequence: Synthetic oligonucleotide
  Target: FXN; (+) strand; PAM type: YTN; PAM sequence: TTG
attagccaaaactcggtgat

SEQ ID NO: 34403 - DNA, 20 bp, Artificial Sequence
  Description of Artificial Sequence: Synthetic oligonucleotide
  Target: FXN; (+) strand; PAM type: YTN; PAM sequence: TTA
gccaaaactcggtgattggt

SEQ ID NO: 34404 - DNA, 20 bp, Artificial Sequence
  Description of Artificial Sequence: Synthetic oligonucleotide
  Target: FXN; (+) strand; PAM type: YTN; PAM sequence: CTC
ggtgattggtacaagagtag

SEQ ID NO: 34405 - DNA, 20 bp, Artificial Sequence
  Description of Artificial Sequence: Synthetic oligonucleotide
  Target: FXN; (+) strand; PAM type: YTN; PAM sequence: TTG
gtacaagagtagattgcagt

SEQ ID NO: 34406 - DNA, 20 bp, Artificial Sequence
  Description of Artificial Sequence: Synthetic oligonucleotide
  Target: FXN; (+) strand; PAM type: YTN; PAM sequence: TTG
cagttcactatgtacagaga

SEQ ID NO: 34407 - DNA, 20 bp, Artificial Sequence
  Description of Artificial Sequence: Synthetic oligonucleotide
  Target: FXN; (+) strand; PAM type: YTN; PAM sequence: TTC
actatgtacagagaagccct

SEQ ID NO: 34408 - DNA, 20 bp, Artificial Sequence
  Description of Artificial Sequence: Synthetic oligonucleotide
  Target: FXN; (+) strand; PAM type: YTN; PAM sequence: CTA
tgtacagagaagcccttaga

SEQ ID NO: 34409 - DNA, 20 bp, Artificial Sequence
  Description of Artificial Sequence: Synthetic oligonucleotide
  Target: FXN; (+) strand; PAM type: YTN; PAM sequence: CTT
agatccgaactcaaaatagg

SEQ ID NO: 34410 - DNA, 20 bp, Artificial Sequence
  Description of Artificial Sequence: Synthetic oligonucleotide
  Target: FXN; (+) strand; PAM type: YTN; PAM sequence: TTA
gatccgaactcaaaataggt

SEQ ID NO: 34411 - DNA, 20 bp, Artificial Sequence
  Description of Artificial Sequence: Synthetic oligonucleotide
  Target: FXN; (+) strand; PAM type: YTN; PAM sequence: CTC
aaaataggtaaggaggcagt

SEQ ID NO: 34412 - DNA, 20 bp, Artificial Sequence
  Description of Artificial Sequence: Synthetic oligonucleotide
  Target: FXN; (+) strand; PAM type: YTN; PAM sequence: TTT
tagctacacttaagttaaca

SEQ ID NO: 34413 - DNA, 20 bp, Artificial Sequence
  Description of Artificial Sequence: Synthetic oligonucleotide
  Target: FXN; (+) strand; PAM type: YTN; PAM sequence: TTT
agctacacttaagttaacat

SEQ ID NO: 34414 - DNA, 20 bp, Artificial Sequence
  Description of Artificial Sequence: Synthetic oligonucleotide
  Target: FXN; (+) strand; PAM type: YTN; PAM sequence: TTA
gctacacttaagttaacata

SEQ ID NO: 34415 - DNA, 20 bp, Artificial Sequence
  Description of Artificial Sequence: Synthetic oligonucleotide
  Target: FXN; (+) strand; PAM type: YTN; PAM sequence: CTA
cacttaagttaacatactca

SEQ ID NO: 34416 - DNA, 20 bp, Artificial Sequence
  Description of Artificial Sequence: Synthetic oligonucleotide
  Target: FXN; (+) strand; PAM type: YTN; PAM sequence: CTT
aagttaacatactcaggagt

SEQ ID NO: 34417 - DNA, 20 bp, Artificial Sequence
  Description of Artificial Sequence: Synthetic oligonucleotide
  Target: FXN; (+) strand; PAM type: YTN; PAM sequence: TTA
agttaacatactcaggagta

SEQ ID NO: 34418 - DNA, 20 bp, Artificial Sequence
  Description of Artificial Sequence: Synthetic oligonucleotide
  Target: FXN; (+) strand; PAM type: YTN; PAM sequence: TTA
acatactcaggagtaccatt

SEQ ID NO: 34419 - DNA, 20 bp, Artificial Sequence
  Description of Artificial Sequence: Synthetic oligonucleotide
  Target: FXN; (+) strand; PAM type: YTN; PAM sequence: CTC
aggagtaccattccagcttc

SEQ ID NO: 34420 - DNA, 20 bp, Artificial Sequence
  Description of Artificial Sequence: Synthetic oligonucleotide
  Target: FXN; (+) strand; PAM type: YTN; PAM sequence: TTC
cagcttcaagctggaagtgt

SEQ ID NO: 34421 - DNA, 20 bp, Artificial Sequence
  Description of Artificial Sequence: Synthetic oligonucleotide
  Target: FXN; (+) strand; PAM type: YTN; PAM sequence: CTT
caagctggaagtgtctgcag

SEQ ID NO: 34422 - DNA, 20 bp, Artificial Sequence
  Description of Artificial Sequence: Synthetic oligonucleotide
  Target: FXN; (+) strand; PAM type: YTN; PAM sequence: TTC
aagctggaagtgtctgcagc

SEQ ID NO: 34423 - DNA, 20 bp, Artificial Sequence
  Description of Artificial Sequence: Synthetic oligonucleotide
  Target: FXN; (+) strand; PAM type: YTN; PAM sequence: CTG
gaagtgtctgcagccccctg

SEQ ID NO: 34424 - DNA, 20 bp, Artificial Sequence
  Description of Artificial Sequence: Synthetic oligonucleotide
  Target: FXN; (+) strand; PAM type: YTN; PAM sequence: CTG
cagccccctgagaccactta

SEQ ID NO: 34425 - DNA, 20 bp, Artificial Sequence
  Description of Artificial Sequence: Synthetic oligonucleotide
  Target: FXN; (+) strand; PAM type: YTN; PAM sequence: CTG
agaccacttaatcccaagtt

SEQ ID NO: 34426 - DNA, 20 bp, Artificial Sequence
  Description of Artificial Sequence: Synthetic oligonucleotide
  Target: FXN; (+) strand; PAM type: YTN; PAM sequence: CTT
aatcccaagttaaaaacccc

SEQ ID NO: 34427 - DNA, 20 bp, Artificial Sequence
  Description of Artificial Sequence: Synthetic oligonucleotide
  Target: FXN; (+) strand; PAM type: YTN; PAM sequence: TTA
atcccaagttaaaaacccct

SEQ ID NO: 34428 - DNA, 20 bp, Artificial Sequence
  Description of Artificial Sequence: Synthetic oligonucleotide
  Target: FXN; (+) strand; PAM type: YTN; PAM sequence: TTA
aaaacccctgctcagaggca

SEQ ID NO: 34429 - DNA, 20 bp, Artificial Sequence
  Description of Artificial Sequence: Synthetic oligonucleotide
  Target: FXN; (+) strand; PAM type: YTN; PAM sequence: CTG
ctcagaggcagcatcttttt

SEQ ID NO: 34430 - DNA, 20 bp, Artificial Sequence
  Description of Artificial Sequence: Synthetic oligonucleotide
  Target: FXN; (+) strand; PAM type: YTN; PAM sequence: CTC
agaggcagcatctttttttt

SEQ ID NO: 34431 - DNA, 20 bp, Artificial Sequence
  Description of Artificial Sequence: Synthetic oligonucleotide
  Target: FXN; (+) strand; PAM type: YTN; PAM sequence: CTT
tttttttttttttttttttt

SEQ ID NO: 34432 - DNA, 20 bp, Artificial Sequence
  Description of Artificial Sequence: Synthetic oligonucleotide
  Target: FXN; (+) strand; PAM type: YTN; PAM sequence: TTT
tttttttttttttttttttt

SEQ ID NO: 34433 - DNA, 20 bp, Artificial Sequence
  Description of Artificial Sequence: Synthetic oligonucleotide
  Target: FXN; (+) strand; PAM type: YTN; PAM sequence: TTT
tttttttttttttttttttt

SEQ ID NO: 34434 - DNA, 20 bp, Artificial Sequence
  Description of Artificial Sequence: Synthetic oligonucleotide
  Target: FXN; (+) strand; PAM type: YTN; PAM sequence: TTT
tttttttttttttttttttt

SEQ ID NO: 34435 - DNA, 20 bp, Artificial Sequence
  Description of Artificial Sequence: Synthetic oligonucleotide
  Target: FXN; (+) strand; PAM type: YTN; PAM sequence: TTT
tttttttttttttttttttt

SEQ ID NO: 34436 - DNA, 20 bp, Artificial Sequence
  Description of Artificial Sequence: Synthetic oligonucleotide
  Target: FXN; (+) strand; PAM type: YTN; PAM sequence: TTT
tttttttttttttttttttt

SEQ ID NO: 34437 - DNA, 20 bp, Artificial Sequence
  Description of Artificial Sequence: Synthetic oligonucleotide
  Target: FXN; (+) strand; PAM type: YTN; PAM sequence: TTT
tttttttttttttttttttg

SEQ ID NO: 34438 - DNA, 20 bp, Artificial Sequence
  Description of Artificial Sequence: Synthetic oligonucleotide
  Target: FXN; (+) strand; PAM type: YTN; PAM sequence: TTT
ttttttttttttttttttga

SEQ ID NO: 34439 - DNA, 20 bp, Artificial Sequence
  Description of Artificial Sequence: Synthetic oligonucleotide
  Target: FXN; (+) strand; PAM type: YTN; PAM sequence: TTT
tttttttttttttttttgag

SEQ ID NO: 34440 - DNA, 20 bp, Artificial Sequence
  Description of Artificial Sequence: Synthetic oligonucleotide
  Target: FXN; (+) strand; PAM type: YTN; PAM sequence: TTT
ttttttttttttttttgaga

SEQ ID NO: 34441 - DNA, 20 bp, Artificial Sequence
  Description of Artificial Sequence: Synthetic oligonucleotide
  Target: FXN; (+) strand; PAM type: YTN; PAM sequence: TTT
tttttttttttttttgagag

SEQ ID NO: 34442 - DNA, 20 bp, Artificial Sequence
  Description of Artificial Sequence: Synthetic oligonucleotide
  Target: FXN; (+) strand; PAM type: YTN; PAM sequence: TTT
ttttttttttttttgagaga

SEQ ID NO: 34443 - DNA, 20 bp, Artificial Sequence
  Description of Artificial Sequence: Synthetic oligonucleotide
  Target: FXN; (+) strand; PAM type: YTN; PAM sequence: TTT
tttttttttttttgagagag

SEQ ID NO: 34444 - DNA, 20 bp, Artificial Sequence
  Description of Artificial Sequence: Synthetic oligonucleotide
  Target: FXN; (+) strand; PAM type: YTN; PAM sequence: TTT
ttttttttttttgagagaga

SEQ ID NO: 34445 - DNA, 20 bp, Artificial Sequence
  Description of Artificial Sequence: Synthetic oligonucleotide
  Target: FXN; (+) strand; PAM type: YTN; PAM sequence: TTT
tttttttttttgagagagat

SEQ ID NO: 34446 - DNA, 20 bp, Artificial Sequence
  Description of Artificial Sequence: Synthetic oligonucleotide
  Target: FXN; (+) strand; PAM type: YTN; PAM sequence: TTT
ttttttttttgagagagatc

SEQ ID NO: 34447 - DNA, 20 bp, Artificial Sequence
  Description of Artificial Sequence: Synthetic oligonucleotide
  Target: FXN; (+) strand; PAM type: YTN; PAM sequence: TTT
tttttttttgagagagatct

SEQ ID NO: 34448 - DNA, 20 bp, Artificial Sequence
  Description of Artificial Sequence: Synthetic oligonucleotide
  Target: FXN; (+) strand; PAM type: YTN; PAM sequence: TTT
ttttttttgagagagatctc

SEQ ID NO: 34449 - DNA, 20 bp, Artificial Sequence
  Description of Artificial Sequence: Synthetic oligonucleotide
  Target: FXN; (+) strand; PAM type: YTN; PAM sequence: TTT
tttttttgagagagatctca

SEQ ID NO: 34450 - DNA, 20 bp, Artificial Sequence
  Description of Artificial Sequence: Synthetic oligonucleotide
  Target: FXN; (+) strand; PAM type: YTN; PAM sequence: TTT
ttttttgagagagatctcac

SEQ ID NO: 34451 - DNA, 20 bp, Artificial Sequence
  Description of Artificial Sequence: Synthetic oligonucleotide
  Target: FXN; (+) strand; PAM type: YTN; PAM sequence: TTT
tttttgagagagatctcact

SEQ ID NO: 34452 - DNA, 20 bp, Artificial Sequence
  Description of Artificial Sequence: Synthetic oligonucleotide
  Target: FXN; (+) strand; PAM type: YTN; PAM sequence: TTT
ttttgagagagatctcactc

SEQ ID NO: 34453 - DNA, 20 bp, Artificial Sequence
  Description of Artificial Sequence: Synthetic oligonucleotide
  Target: FXN; (+) strand; PAM type: YTN; PAM sequence: TTT
tttgagagagatctcactct

SEQ ID NO: 34454 - DNA, 20 bp, Artificial Sequence
  Description of Artificial Sequence: Synthetic oligonucleotide
  Target: FXN; (+) strand; PAM type: YTN; PAM sequence: TTT
ttgagagagatctcactctg

SEQ ID NO: 34455 - DNA, 20 bp, Artificial Sequence
  Description of Artificial Sequence: Synthetic oligonucleotide
  Target: FXN; (+) strand; PAM type: YTN; PAM sequence: TTT
tgagagagatctcactctgt

SEQ ID NO: 34456 - DNA, 20 bp, Artificial Sequence
  Description of Artificial Sequence: Synthetic oligonucleotide
  Target: FXN; (+) strand; PAM type: YTN; PAM sequence: TTT
gagagagatctcactctgtc

SEQ ID NO: 34457 - DNA, 20 bp, Artificial Sequence
  Description of Artificial Sequence: Synthetic oligonucleotide
  Target: FXN; (+) strand; PAM type: YTN; PAM sequence: TTG
agagagatctcactctgtca

SEQ ID NO: 34458 - DNA, 20 bp, Artificial Sequence
  Description of Artificial Sequence: Synthetic oligonucleotide
  Target: FXN; (+) strand; PAM type: YTN; PAM sequence: CTC
actctgtcacccaggctgga

SEQ ID NO: 34459 - DNA, 20 bp, Artificial Sequence
  Description of Artificial Sequence: Synthetic oligonucleotide
  Target: FXN; (+) strand; PAM type: YTN; PAM sequence: CTC
tgtcacccaggctggagtgc

SEQ ID NO: 34460 - DNA, 20 bp, Artificial Sequence
  Description of Artificial Sequence: Synthetic oligonucleotide
  Target: FXN; (+) strand; PAM type: YTN; PAM sequence: CTG
tcacccaggctggagtgcag

SEQ ID NO: 34461 - DNA, 20 bp, Artificial Sequence
  Description of Artificial Sequence: Synthetic oligonucleotide
  Target: FXN; (+) strand; PAM type: YTN; PAM sequence: CTG
gagtgcagtggcacgatctc

SEQ ID NO: 34462 - DNA, 20 bp, Artificial Sequence
  Description of Artificial Sequence: Synthetic oligonucleotide
  Target: FXN; (+) strand; PAM type: YTN; PAM sequence: CTC
agctcactgcaaccaccacc

SEQ ID NO: 34463 - DNA, 20 bp, Artificial Sequence
  Description of Artificial Sequence: Synthetic oligonucleotide
  Target: FXN; (+) strand; PAM type: YTN; PAM sequence: CTC
actgcaaccaccacctcctg

SEQ ID NO: 34464 - DNA, 20 bp, Artificial Sequence
  Description of Artificial Sequence: Synthetic oligonucleotide
  Target: FXN; (+) strand; PAM type: YTN; PAM sequence: CTG
caaccaccacctcctgggct

SEQ ID NO: 34465 - DNA, 20 bp, Artificial Sequence
  Description of Artificial Sequence: Synthetic oligonucleotide
  Target: FXN; (+) strand; PAM type: YTN; PAM sequence: CTC
ctgggctcaagggattctct

SEQ ID NO: 34466 - DNA, 20 bp, Artificial Sequence
  Description of Artificial Sequence: Synthetic oligonucleotide
  Target: FXN; (+) strand; PAM type: YTN; PAM sequence: CTG
ggctcaagggattctcttgc

SEQ ID NO: 34467 - DNA, 20 bp, Artificial Sequence
  Description of Artificial Sequence: Synthetic oligonucleotide
  Target: FXN; (+) strand; PAM type: YTN; PAM sequence: CTC
aagggattctcttgcctcag

SEQ ID NO: 34468 - DNA, 20 bp, Artificial Sequence
  Description of Artificial Sequence: Synthetic oligonucleotide
  Target: FXN; (+) strand; PAM type: YTN; PAM sequence: TTC
tcttgcctcagtctcccgag

SEQ ID NO: 34469 - DNA, 20 bp, Artificial Sequence
  Description of Artificial Sequence: Synthetic oligonucleotide
  Target: FXN; (+) strand; PAM type: YTN; PAM sequence: CTC
ttgcctcagtctcccgagta

SEQ ID NO: 34470 - DNA, 20 bp, Artificial Sequence
  Description of Artificial Sequence: Synthetic oligonucleotide
  Target: FXN; (+) strand; PAM type: YTN; PAM sequence: CTT
gcctcagtctcccgagtaac

SEQ ID NO: 34471 - DNA, 20 bp, Artificial Sequence
  Description of Artificial Sequence: Synthetic oligonucleotide
  Target: FXN; (+) strand; PAM type: YTN; PAM sequence: TTG
cctcagtctcccgagtaact

SEQ ID NO: 34472 - DNA, 20 bp, Artificial Sequence
  Description of Artificial Sequence: Synthetic oligonucleotide
  Target: FXN; (+) strand; PAM type: YTN; PAM sequence: CTC
agtctcccgagtaactggga

SEQ ID NO: 34473 - DNA, 20 bp, Artificial Sequence
  Description of Artificial Sequence: Synthetic oligonucleotide
  Target: FXN; (+) strand; PAM type: YTN; PAM sequence: CTC
ccgagtaactgggattacag

SEQ ID NO: 34474 - DNA, 20 bp, Artificial Sequence
  Description of Artificial Sequence: Synthetic oligonucleotide
  Target: FXN; (+) strand; PAM type: YTN; PAM sequence: CTG
ggattacaggcgcgtgccac

SEQ ID NO: 34475 - DNA, 20 bp, Artificial Sequence
  Description of Artificial Sequence: Synthetic oligonucleotide
  Target: FXN; (+) strand; PAM type: YTN; PAM sequence: TTA
caggcgcgtgccactatgtc

SEQ ID NO: 34476 - DNA, 20 bp, Artificial Sequence
  Description of Artificial Sequence: Synthetic oligonucleotide
  Target: FXN; (+) strand; PAM type: YTN; PAM sequence: CTA
tgtccagctaattttttttt

SEQ ID NO: 34477 - DNA, 20 bp, Artificial Sequence
  Description of Artificial Sequence: Synthetic oligonucleotide
  Target: FXN; (+) strand; PAM type: YTN; PAM sequence: CTA
atttttttttttgtattttt

SEQ ID NO: 34478 - DNA, 20 bp, Artificial Sequence
  Description of Artificial Sequence: Synthetic oligonucleotide
  Target: FXN; (+) strand; PAM type: YTN; PAM sequence: TTT
ttttttttgtatttttagta

SEQ ID NO: 34479 - DNA, 20 bp, Artificial Sequence
  Description of Artificial Sequence: Synthetic oligonucleotide
  Target: FXN; (+) strand; PAM type: YTN; PAM sequence: TTT
tttttttgtatttttagtag

SEQ ID NO: 34480 - DNA, 20 bp, Artificial Sequence
  Description of Artificial Sequence: Synthetic oligonucleotide
  Target: FXN; (+) strand; PAM type: YTN; PAM sequence: TTT
ttttttgtatttttagtaga

SEQ ID NO: 34481 - DNA, 20 bp, Artificial Sequence
  Description of Artificial Sequence: Synthetic oligonucleotide
  Target: FXN; (+) strand; PAM type: YTN; PAM sequence: TTT
tttttgtatttttagtagag

SEQ ID NO: 34482 - DNA, 20 bp, Artificial Sequence
  Description of Artificial Sequence: Synthetic oligonucleotide
  Target: FXN; (+) strand; PAM type: YTN; PAM sequence: TTT
ttttgtatttttagtagaga

SEQ ID NO: 34483 - DNA, 20 bp, Artificial Sequence
  Description of Artificial Sequence: Synthetic oligonucleotide
  Target: FXN; (+) strand; PAM type: YTN; PAM sequence: TTT
tttgtatttttagtagagat

SEQ ID NO: 34484 - DNA, 20 bp, Artificial Sequence
  Description of Artificial Sequence: Synthetic oligonucleotide
  Target: FXN; (+) strand; PAM type: YTN; PAM sequence: TTT
ttgtatttttagtagagatg

SEQ ID NO: 34485 - DNA, 20 bp, Artificial Sequence
  Description of Artificial Sequence: Synthetic oligonucleotide
  Target: FXN; (+) strand; PAM type: YTN; PAM sequence: TTT
tgtatttttagtagagatgg

SEQ ID NO: 34486 - DNA, 20 bp, Artificial Sequence
  Description of Artificial Sequence: Synthetic oligonucleotide
  Target: FXN; (+) strand; PAM type: YTN; PAM sequence: TTT
gtatttttagtagagatggg

SEQ ID NO: 34487 - DNA, 20 bp, Artificial Sequence
  Description of Artificial Sequence: Synthetic oligonucleotide
  Target: FXN; (+) strand; PAM type: YTN; PAM sequence: TTG
tatttttagtagagatgggg

SEQ ID NO: 34488 - DNA, 20 bp, Artificial Sequence
  Description of Artificial Sequence: Synthetic oligonucleotide
  Target: FXN; (+) strand; PAM type: YTN; PAM sequence: TTT
ttagtagagatggggtttca

SEQ ID NO: 34489 - DNA, 20 bp, Artificial Sequence
  Description of Artificial Sequence: Synthetic oligonucleotide
  Target: FXN; (+) strand; PAM type: YTN; PAM sequence: TTT
tagtagagatggggtttcac

SEQ ID NO: 34490 - DNA, 20 bp, Artificial Sequence
  Description of Artificial Sequence: Synthetic oligonucleotide
  Target: FXN; (+) strand; PAM type: YTN; PAM sequence: TTT
agtagagatggggtttcacc

SEQ ID NO: 34491 - DNA, 20 bp, Artificial Sequence
  Description of Artificial Sequence: Synthetic oligonucleotide
  Target: FXN; (+) strand; PAM type: YTN; PAM sequence: TTA
gtagagatggggtttcacca

SEQ ID NO: 34492 - DNA, 20 bp, Artificial Sequence
  Description of Artificial Sequence: Synthetic oligonucleotide
  Target: FXN; (+) strand; PAM type: YTN; PAM sequence: TTT
caccatgttggcctggctgg

SEQ ID NO: 34493 - DNA, 20 bp, Artificial Sequence
  Description of Artificial Sequence: Synthetic oligonucleotide
  Target: FXN; (+) strand; PAM type: YTN; PAM sequence: TTC
accatgttggcctggctggt

SEQ ID NO: 34494 - DNA, 20 bp, Artificial Sequence
  Description of Artificial Sequence: Synthetic oligonucleotide
  Target: FXN; (+) strand; PAM type: YTN; PAM sequence: TTG
gcctggctggtcttgaactc

SEQ ID NO: 34495 - DNA, 20 bp, Artificial Sequence
  Description of Artificial Sequence: Synthetic oligonucleotide
  Target: FXN; (+) strand; PAM type: YTN; PAM sequence: CTG
gctggtcttgaactcttgac

SEQ ID NO: 34496 - DNA, 20 bp, Artificial Sequence
  Description of Artificial Sequence: Synthetic oligonucleotide
  Target: FXN; (+) strand; PAM type: YTN; PAM sequence: CTG
gtcttgaactcttgacctca

SEQ ID NO: 34497 - DNA, 20 bp, Artificial Sequence
  Description of Artificial Sequence: Synthetic oligonucleotide
  Target: FXN; (+) strand; PAM type: YTN; PAM sequence: CTT
gaactcttgacctcaagtga

SEQ ID NO: 34498 - DNA, 20 bp, Artificial Sequence
  Description of Artificial Sequence: Synthetic oligonucleotide
  Target: FXN; (+) strand; PAM type: YTN; PAM sequence: TTG
aactcttgacctcaagtgat

SEQ ID NO: 34499 - DNA, 20 bp, Artificial Sequence
  Description of Artificial Sequence: Synthetic oligonucleotide
  Target: FXN; (+) strand; PAM type: YTN; PAM sequence: CTC
ttgacctcaagtgatccact

SEQ ID NO: 34500 - DNA, 20 bp, Artificial Sequence
  Description of Artificial Sequence: Synthetic oligonucleotide
  Target: FXN; (+) strand; PAM type: YTN; PAM sequence: CTT
gacctcaagtgatccactgg

SEQ ID NO: 34501 - DNA, 20 bp, Artificial Sequence
  Description of Artificial Sequence: Synthetic oligonucleotide
  Target: FXN; (+) strand; PAM type: YTN; PAM sequence: TTG
acctcaagtgatccactggc

SEQ ID NO: 34502 - DNA, 20 bp, Artificial Sequence
  Description of Artificial Sequence: Synthetic oligonucleotide
  Target: FXN; (+) strand; PAM type: YTN; PAM sequence: CTC
aagtgatccactggcctcag

SEQ ID NO: 34503 - DNA, 20 bp, Artificial Sequence
  Description of Artificial Sequence: Synthetic oligonucleotide
  Target: FXN; (+) strand; PAM type: YTN; PAM sequence: CTG
gcctcagcctcccaaagtgc

SEQ ID NO: 34504 - DNA, 20 bp, Artificial Sequence
  Description of Artificial Sequence: Synthetic oligonucleotide
  Target: FXN; (+) strand; PAM type: YTN; PAM sequence: CTC
agcctcccaaagtgctggca

SEQ ID NO: 34505 - DNA, 20 bp, Artificial Sequence
  Description of Artificial Sequence: Synthetic oligonucleotide
  Target: FXN; (+) strand; PAM type: YTN; PAM sequence: CTC
ccaaagtgctggcattagag

SEQ ID NO: 34506 - DNA, 20 bp, Artificial Sequence
  Description of Artificial Sequence: Synthetic oligonucleotide
  Target: FXN; (+) strand; PAM type: YTN; PAM sequence: CTG
gcattagaggtgtgagtcac

SEQ ID NO: 34507 - DNA, 20 bp, Artificial Sequence
  Description of Artificial Sequence: Synthetic oligonucleotide
  Target: FXN; (+) strand; PAM type: YTN; PAM sequence: TTA
gaggtgtgagtcactgttcc

SEQ ID NO: 34508 - DNA, 20 bp, Artificial Sequence
  Description of Artificial Sequence: Synthetic oligonucleotide
  Target: FXN; (+) strand; PAM type: YTN; PAM sequence: CTG
ttcctggcccagtgaggcac

SEQ ID NO: 34509 - DNA, 20 bp, Artificial Sequence
  Description of Artificial Sequence: Synthetic oligonucleotide
  Target: FXN; (+) strand; PAM type: YTN; PAM sequence: TTC
ctggcccagtgaggcaccat

SEQ ID NO: 34510 - DNA, 20 bp, Artificial Sequence
  Description of Artificial Sequence: Synthetic oligonucleotide
  Target: FXN; (+) strand; PAM type: YTN; PAM sequence: CTG
gcccagtgaggcaccatctc

SEQ ID NO: 34511 - DNA, 20 bp, Artificial Sequence
  Description of Artificial Sequence: Synthetic oligonucleotide
  Target: FXN; (+) strand; PAM type: YTN; PAM sequence: CTC
attggatatggagacaaagg

SEQ ID NO: 34512 - DNA, 20 bp, Artificial Sequence
  Description of Artificial Sequence: Synthetic oligonucleotide
  Target: FXN; (+) strand; PAM type: YTN; PAM sequence: TTG
gatatggagacaaaggatct

SEQ ID NO: 34513 - DNA, 20 bp, Artificial Sequence
  Description of Artificial Sequence: Synthetic oligonucleotide
  Target: FXN; (+) strand; PAM type: YTN; PAM sequence: CTG
gcttagcatcctggatttgt

SEQ ID NO: 34514 - DNA, 20 bp, Artificial Sequence
  Description of Artificial Sequence: Synthetic oligonucleotide
  Target: FXN; (+) strand; PAM type: YTN; PAM sequence: CTT
agcatcctggatttgtattt

SEQ ID NO: 34515 - DNA, 20 bp, Artificial Sequence
  Description of Artificial Sequence: Synthetic oligonucleotide
  Target: FXN; (+) strand; PAM type: YTN; PAM sequence: TTA
gcatcctggatttgtatttt

SEQ ID NO: 34516 - DNA, 20 bp, Artificial Sequence
  Description of Artificial Sequence: Synthetic oligonucleotide
  Target: FXN; (+) strand; PAM type: YTN; PAM sequence: CTG
gatttgtattttctttccaa

SEQ ID NO: 34517 - DNA, 20 bp, Artificial Sequence
  Description of Artificial Sequence: Synthetic oligonucleotide
  Target: FXN; (+) strand; PAM type: YTN; PAM sequence: TTT
gtattttctttccaagagtc

SEQ ID NO: 34518 - DNA, 20 bp, Artificial Sequence
  Description of Artificial Sequence: Synthetic oligonucleotide
  Target: FXN; (+) strand; PAM type: YTN; PAM sequence: TTG
tattttctttccaagagtcc

SEQ ID NO: 34519 - DNA, 20 bp, Artificial Sequence
  Description of Artificial Sequence: Synthetic oligonucleotide
  Target: FXN; (+) strand; PAM type: YTN; PAM sequence: TTT
tctttccaagagtccttaag

SEQ ID NO: 34520 - DNA, 20 bp, Artificial Sequence
  Description of Artificial Sequence: Synthetic oligonucleotide
  Target: FXN; (+) strand; PAM type: YTN; PAM sequence: TTT
ctttccaagagtccttaagt

SEQ ID NO: 34521 - DNA, 20 bp, Artificial Sequence
  Description of Artificial Sequence: Synthetic oligonucleotide
  Target: FXN; (+) strand; PAM type: YTN; PAM sequence: TTC
tttccaagagtccttaagtg

SEQ ID NO: 34522 - DNA, 20 bp, Artificial Sequence
  Description of Artificial Sequence: Synthetic oligonucleotide
  Target: FXN; (+) strand; PAM type: YTN; PAM sequence: CTT
tccaagagtccttaagtgat

SEQ ID NO: 34523 - DNA, 20 bp, Artificial Sequence
  Description of Artificial Sequence: Synthetic oligonucleotide
  Target: FXN; (+) strand; PAM type: YTN; PAM sequence: TTT
ccaagagtccttaagtgata

SEQ ID NO: 34524 - DNA, 20 bp, Artificial Sequence
  Description of Artificial Sequence: Synthetic oligonucleotide
  Target: FXN; (+) strand; PAM type: YTN; PAM sequence: TTC
caagagtccttaagtgatat

SEQ ID NO: 34525 - DNA, 20 bp, Artificial Sequence
  Description of Artificial Sequence: Synthetic oligonucleotide
  Target: FXN; (+) strand; PAM type: YTN; PAM sequence: CTT
aagtgatatctaacttttgc

SEQ ID NO: 34526 - DNA, 20 bp, Artificial Sequence
  Description of Artificial Sequence: Synthetic oligonucleotide
  Target: FXN; (+) strand; PAM type: YTN; PAM sequence: TTA
agtgatatctaacttttgcg

SEQ ID NO: 34527 - DNA, 20 bp, Artificial Sequence
  Description of Artificial Sequence: Synthetic oligonucleotide
  Target: FXN; (+) strand; PAM type: YTN; PAM sequence: CTA
acttttgcgagctgcagttt

SEQ ID NO: 34528 - DNA, 20 bp, Artificial Sequence
  Description of Artificial Sequence: Synthetic oligonucleotide
  Target: FXN; (+) strand; PAM type: YTN; PAM sequence: CTT
ttgcgagctgcagtttcctc

SEQ ID NO: 34529 - DNA, 20 bp, Artificial Sequence
  Description of Artificial Sequence: Synthetic oligonucleotide
  Target: FXN; (+) strand; PAM type: YTN; PAM sequence: TTT
tgcgagctgcagtttcctca

SEQ ID NO: 34530 - DNA, 20 bp, Artificial Sequence
  Description of Artificial Sequence: Synthetic oligonucleotide
  Target: FXN; (+) strand; PAM type: YTN; PAM sequence: TTT
gcgagctgcagtttcctcag

SEQ ID NO: 34531 - DNA, 20 bp, Artificial Sequence
  Description of Artificial Sequence: Synthetic oligonucleotide
  Target: FXN; (+) strand; PAM type: YTN; PAM sequence: TTG
cgagctgcagtttcctcagc

SEQ ID NO: 34532 - DNA, 20 bp, Artificial Sequence
  Description of Artificial Sequence: Synthetic oligonucleotide
  Target: FXN; (+) strand; PAM type: YTN; PAM sequence: CTG
cagtttcctcagctatgaga

SEQ ID NO: 34533 - DNA, 20 bp, Artificial Sequence
  Description of Artificial Sequence: Synthetic oligonucleotide
  Target: FXN; (+) strand; PAM type: YTN; PAM sequence: TTT
cctcagctatgagatgagtg

SEQ ID NO: 34534 - DNA, 20 bp, Artificial Sequence
  Description of Artificial Sequence: Synthetic oligonucleotide
  Target: FXN; (+) strand; PAM type: YTN; PAM sequence: TTC
ctcagctatgagatgagtga

SEQ ID NO: 34535 - DNA, 20 bp, Artificial Sequence
  Description of Artificial Sequence: Synthetic oligonucleotide
  Target: FXN; (+) strand; PAM type: YTN; PAM sequence: CTC
agctatgagatgagtgacat

SEQ ID NO: 34536 - DNA, 20 bp, Artificial Sequence
  Description of Artificial Sequence: Synthetic oligonucleotide
  Target: FXN; (+) strand; PAM type: YTN; PAM sequence: CTA
tgagatgagtgacattaacc

SEQ ID NO: 34537 - DNA, 20 bp, Artificial Sequence
  Description of Artificial Sequence: Synthetic oligonucleotide
  Target: FXN; (+) strand; PAM type: YTN; PAM sequence: TTA
acctcctctcttcagattta

SEQ ID NO: 34538 - DNA, 20 bp, Artificial Sequence
  Description of Artificial Sequence: Synthetic oligonucleotide
  Target: FXN; (+) strand; PAM type: YTN; PAM sequence: CTC
ctctcttcagatttataaga

SEQ ID NO: 34539 - DNA, 20 bp, Artificial Sequence
  Description of Artificial Sequence: Synthetic oligonucleotide
  Target: FXN; (+) strand; PAM type: YTN; PAM sequence: CTC
tcttcagatttataagagga

SEQ ID NO: 34540 - DNA, 20 bp, Artificial Sequence
  Description of Artificial Sequence: Synthetic oligonucleotide
  Target: FXN; (+) strand; PAM type: YTN; PAM sequence: CTC
ttcagatttataagaggatc

SEQ ID NO: 34541 - DNA, 20 bp, Artificial Sequence
  Description of Artificial Sequence: Synthetic oligonucleotide
  Target: FXN; (+) strand; PAM type: YTN; PAM sequence: CTT
cagatttataagaggatcaa

SEQ ID NO: 34542 - DNA, 20 bp, Artificial Sequence
  Description of Artificial Sequence: Synthetic oligonucleotide
  Target: FXN; (+) strand; PAM type: YTN; PAM sequence: TTC
agatttataagaggatcaat

SEQ ID NO: 34543 - DNA, 20 bp, Artificial Sequence
  Description of Artificial Sequence: Synthetic oligonucleotide
  Target: FXN; (+) strand; PAM type: YTN; PAM sequence: TTT
ataagaggatcaattaaaat

SEQ ID NO: 34544 - DNA, 20 bp, Artificial Sequence
  Description of Artificial Sequence: Synthetic oligonucleotide
  Target: FXN; (+) strand; PAM type: YTN; PAM sequence: TTA
taagaggatcaattaaaatg

SEQ ID NO: 34545 - DNA, 20 bp, Artificial Sequence
  Description of Artificial Sequence: Synthetic oligonucleotide
  Target: FXN; (+) strand; PAM type: YTN; PAM sequence: TTA
aaatggcataggtaaaagtg

SEQ ID NO: 34546 - DNA, 20 bp, Artificial Sequence
  Description of Artificial Sequence: Synthetic oligonucleotide
  Target: FXN; (+) strand; PAM type: YTN; PAM sequence: CTA
gcaagttggtatctacttta

SEQ ID NO: 34547 - DNA, 20 bp, Artificial Sequence
  Description of Artificial Sequence: Synthetic oligonucleotide
  Target: FXN; (+) strand; PAM type: YTN; PAM sequence: TTG
gtatctactttagaaatgaa

SEQ ID NO: 34548 - DNA, 20 bp, Artificial Sequence
  Description of Artificial Sequence: Synthetic oligonucleotide
  Target: FXN; (+) strand; PAM type: YTN; PAM sequence: CTA
ctttagaaatgaaggaggtc

SEQ ID NO: 34549 - DNA, 20 bp, Artificial Sequence
  Description of Artificial Sequence: Synthetic oligonucleotide
  Target: FXN; (+) strand; PAM type: YTN; PAM sequence: CTT
tagaaatgaaggaggtcata

SEQ ID NO: 34550 - DNA, 20 bp, Artificial Sequence
  Description of Artificial Sequence: Synthetic oligonucleotide
  Target: FXN; (+) strand; PAM type: YTN; PAM sequence: TTT
agaaatgaaggaggtcatat

SEQ ID NO: 34551 - DNA, 20 bp, Artificial Sequence
  Description of Artificial Sequence: Synthetic oligonucleotide
  Target: FXN; (+) strand; PAM type: YTN; PAM sequence: TTA
gaaatgaaggaggtcatatg

SEQ ID NO: 34552 - DNA, 20 bp, Artificial Sequence
  Description of Artificial Sequence: Synthetic oligonucleotide
  Target: FXN; (+) strand; PAM type: YTN; PAM sequence: CTC
cagacccaacatgccatctt

SEQ ID NO: 34553 - DNA, 20 bp, Artificial Sequence
  Description of Artificial Sequence: Synthetic oligonucleotide
  Target: FXN; (+) strand; PAM type: YTN; PAM sequence: CTT
atatgtgtctatttctacaa

SEQ ID NO: 34554 - DNA, 20 bp, Artificial Sequence
  Description of Artificial Sequence: Synthetic oligonucleotide
  Target: FXN; (+) strand; PAM type: YTN; PAM sequence: TTA
tatgtgtctatttctacaag

SEQ ID NO: 34555 - DNA, 20 bp, Artificial Sequence
  Description of Artificial Sequence: Synthetic oligonucleotide
  Target: FXN; (+) strand; PAM type: YTN; PAM sequence: CTA
tttctacaagtgagctagtg

SEQ ID NO: 34556 - DNA, 20 bp, Artificial Sequence
  Description of Artificial Sequence: Synthetic oligonucleotide
  Target: FXN; (+) strand; PAM type: YTN; PAM sequence: TTT
ctacaagtgagctagtgaca

SEQ ID NO: 34557 - DNA, 20 bp, Artificial Sequence
  Description of Artificial Sequence: Synthetic oligonucleotide
  Target: FXN; (+) strand; PAM type: YTN; PAM sequence: TTC
tacaagtgagctagtgacaa

SEQ ID NO: 34558 - DNA, 20 bp, Artificial Sequence
  Description of Artificial Sequence: Synthetic oligonucleotide
  Target: FXN; (+) strand; PAM type: YTN; PAM sequence: CTA
caagtgagctagtgacaaca

SEQ ID NO: 34559 - DNA, 20 bp, Artificial Sequence
  Description of Artificial Sequence: Synthetic oligonucleotide
  Target: FXN; (+) strand; PAM type: YTN; PAM sequence: CTA
gtgacaacagtaattgctat

SEQ ID NO: 34560 - DNA, 20 bp, Artificial Sequence
  Description of Artificial Sequence: Synthetic oligonucleotide
  Target: FXN; (+) strand; PAM type: YTN; PAM sequence: TTG
ctatttttgctcctacatgg

SEQ ID NO: 34561 - DNA, 20 bp, Artificial Sequence
  Description of Artificial Sequence: Synthetic oligonucleotide
  Target: FXN; (+) strand; PAM type: YTN; PAM sequence: CTA
tttttgctcctacatgggta

SEQ ID NO: 34562 - DNA, 20 bp, Artificial Sequence
  Description of Artificial Sequence: Synthetic oligonucleotide
  Target: FXN; (+) strand; PAM type: YTN; PAM sequence: TTT
ttgctcctacatgggtaggg

SEQ ID NO: 34563 - DNA, 20 bp, Artificial Sequence
  Description of Artificial Sequence: Synthetic oligonucleotide
  Target: FXN; (+) strand; PAM type: YTN; PAM sequence: TTT
tgctcctacatgggtagggc

SEQ ID NO: 34564 - DNA, 20 bp, Artificial Sequence
  Description of Artificial Sequence: Synthetic oligonucleotide
  Target: FXN; (+) strand; PAM type: YTN; PAM sequence: TTT
gctcctacatgggtagggct

SEQ ID NO: 34565 - DNA, 20 bp, Artificial Sequence
  Description of Artificial Sequence: Synthetic oligonucleotide
  Target: FXN; (+) strand; PAM type: YTN; PAM sequence: TTG
ctcctacatgggtagggctg

SEQ ID NO: 34566 - DNA, 20 bp, Artificial Sequence
  Description of Artificial Sequence: Synthetic oligonucleotide
  Target: FXN; (+) strand; PAM type: YTN; PAM sequence: CTC
ctacatgggtagggctgatc

SEQ ID NO: 34567 - DNA, 20 bp, Artificial Sequence
  Description of Artificial Sequence: Synthetic oligonucleotide
  Target: FXN; (+) strand; PAM type: YTN; PAM sequence: CTA
catgggtagggctgatcttg

SEQ ID NO: 34568 - DNA, 20 bp, Artificial Sequence
  Description of Artificial Sequence: Synthetic oligonucleotide
  Target: FXN; (+) strand; PAM type: YTN; PAM sequence: CTG
atcttgactaggaggagtca

SEQ ID NO: 34569 - DNA, 20 bp, Artificial Sequence
  Description of Artificial Sequence: Synthetic oligonucleotide
  Target: FXN; (+) strand; PAM type: YTN; PAM sequence: CTT
gactaggaggagtcaataag

SEQ ID NO: 34570 - DNA, 20 bp, Artificial Sequence
  Description of Artificial Sequence: Synthetic oligonucleotide
  Target: FXN; (+) strand; PAM type: YTN; PAM sequence: TTG
actaggaggagtcaataaga

SEQ ID NO: 34571 - DNA, 20 bp, Artificial Sequence
  Description of Artificial Sequence: Synthetic oligonucleotide
  Target: FXN; (+) strand; PAM type: YTN; PAM sequence: CTA
ggaggagtcaataagactca

SEQ ID NO: 34572 - DNA, 20 bp, Artificial Sequence
  Description of Artificial Sequence: Synthetic oligonucleotide
  Target: FXN; (+) strand; PAM type: YTN; PAM sequence: CTC
accagccgggcgtggtggct

SEQ ID NO: 34573 - DNA, 20 bp, Artificial Sequence
  Description of Artificial Sequence: Synthetic oligonucleotide
  Target: FXN; (+) strand; PAM type: YTN; PAM sequence: CTC
acgcctgtaatcccagcact

SEQ ID NO: 34574 - DNA, 20 bp, Artificial Sequence
  Description of Artificial Sequence: Synthetic oligonucleotide
  Target: FXN; (+) strand; PAM type: YTN; PAM sequence: CTG
taatcccagcactttgggag

SEQ ID NO: 34575 - DNA, 20 bp, Artificial Sequence
  Description of Artificial Sequence: Synthetic oligonucleotide
  Target: FXN; (+) strand; PAM type: YTN; PAM sequence: CTT
tgggaggccaaggcgggcgg

SEQ ID NO: 34576 - DNA, 20 bp, Artificial Sequence
  Description of Artificial Sequence: Synthetic oligonucleotide
  Target: FXN; (+) strand; PAM type: YTN; PAM sequence: TTT
gggaggccaaggcgggcgga

SEQ ID NO: 34577 - DNA, 20 bp, Artificial Sequence
  Description of Artificial Sequence: Synthetic oligonucleotide
  Target: FXN; (+) strand; PAM type: YTN; PAM sequence: TTG
ggaggccaaggcgggcggat

SEQ ID NO: 34578 - DNA, 20 bp, Artificial Sequence
  Description of Artificial Sequence: Synthetic oligonucleotide
  Target: FXN; (+) strand; PAM type: YTN; PAM sequence: TTC
tggctaacacggtgaaaccc

SEQ ID NO: 34579 - DNA, 20 bp, Artificial Sequence
  Description of Artificial Sequence: Synthetic oligonucleotide
  Target: FXN; (+) strand; PAM type: YTN; PAM sequence: CTG
gctaacacggtgaaaccccg

SEQ ID NO: 34580 - DNA, 20 bp, Artificial Sequence
  Description of Artificial Sequence: Synthetic oligonucleotide
  Target: FXN; (+) strand; PAM type: YTN; PAM sequence: CTA
acacggtgaaaccccgtctc

SEQ ID NO: 34581 - DNA, 20 bp, Artificial Sequence
  Description of Artificial Sequence: Synthetic oligonucleotide
  Target: FXN; (+) strand; PAM type: YTN; PAM sequence: CTC
tactaaaaaaatacaaaaaa

SEQ ID NO: 34582 - DNA, 20 bp, Artificial Sequence
  Description of Artificial Sequence: Synthetic oligonucleotide
  Target: FXN; (+) strand; PAM type: YTN; PAM sequence: CTA
ctaaaaaaatacaaaaaaat

SEQ ID NO: 34583 - DNA, 20 bp, Artificial Sequence
  Description of Artificial Sequence: Synthetic oligonucleotide
  Target: FXN; (+) strand; PAM type: YTN; PAM sequence: CTA
aaaaaatacaaaaaaattag

SEQ ID NO: 34584 - DNA, 20 bp, Artificial Sequence
  Description of Artificial Sequence: Synthetic oligonucleotide
  Target: FXN; (+) strand; PAM type: YTN; PAM sequence: TTA
gctgggcgtggtggtgggcg

SEQ ID NO: 34585 - DNA, 20 bp, Artificial Sequence
  Description of Artificial Sequence: Synthetic oligonucleotide
  Target: FXN; (+) strand; PAM type: YTN; PAM sequence: CTG
ggcgtggtggtgggcgcctg

SEQ ID NO: 34586 - DNA, 20 bp, Artificial Sequence
  Description of Artificial Sequence: Synthetic oligonucleotide
  Target: FXN; (+) strand; PAM type: YTN; PAM sequence: CTG
tagtcccagctactcgggaa

SEQ ID NO: 34587 - DNA, 20 bp, Artificial Sequence
  Description of Artificial Sequence: Synthetic oligonucleotide
  Target: FXN; (+) strand; PAM type: YTN; PAM sequence: CTA
ctcgggaagctgaggcagga

SEQ ID NO: 34588 - DNA, 20 bp, Artificial Sequence
  Description of Artificial Sequence: Synthetic oligonucleotide
  Target: FXN; (+) strand; PAM type: YTN; PAM sequence: CTC
gggaagctgaggcaggagaa

SEQ ID NO: 34589 - DNA, 20 bp, Artificial Sequence
  Description of Artificial Sequence: Synthetic oligonucleotide
  Target: FXN; (+) strand; PAM type: YTN; PAM sequence: CTG
aggcaggagaatggcgtgaa

SEQ ID NO: 34590 - DNA, 20 bp, Artificial Sequence
  Description of Artificial Sequence: Synthetic oligonucleotide
  Target: FXN; (+) strand; PAM type: YTN; PAM sequence: CTT
gcagtgaaccaagatcgagc

SEQ ID NO: 34591 - DNA, 20 bp, Artificial Sequence
  Description of Artificial Sequence: Synthetic oligonucleotide
  Target: FXN; (+) strand; PAM type: YTN; PAM sequence: TTG
cagtgaaccaagatcgagcc

SEQ ID NO: 34592 - DNA, 20 bp, Artificial Sequence
  Description of Artificial Sequence: Synthetic oligonucleotide
  Target: FXN; (+) strand; PAM type: YTN; PAM sequence: CTG
cactctagcctgggtgacag

SEQ ID NO: 34593 - DNA, 20 bp, Artificial Sequence
  Description of Artificial Sequence: Synthetic oligonucleotide
  Target: FXN; (+) strand; PAM type: YTN; PAM sequence: CTC
tagcctgggtgacagagcga

SEQ ID NO: 34594 - DNA, 20 bp, Artificial Sequence
  Description of Artificial Sequence: Synthetic oligonucleotide
  Target: FXN; (+) strand; PAM type: YTN; PAM sequence: CTA
gcctgggtgacagagcgaga

SEQ ID NO: 34595 - DNA, 20 bp, Artificial Sequence
  Description of Artificial Sequence: Synthetic oligonucleotide
  Target: FXN; (+) strand; PAM type: YTN; PAM sequence: CTG
ggtgacagagcgagactcca

SEQ ID NO: 34596 - DNA, 20 bp, Artificial Sequence
  Description of Artificial Sequence: Synthetic oligonucleotide
  Target: FXN; (+) strand; PAM type: YTN; PAM sequence: CTC
catctcaaaaaaaaaaaaaa

SEQ ID NO: 34597 - DNA, 20 bp, Artificial Sequence
  Description of Artificial Sequence: Synthetic oligonucleotide
  Target: FXN; (+) strand; PAM type: YTN; PAM sequence: CTC
aaaaaaaaaaaaaagactca

SEQ ID NO: 34598 - DNA, 20 bp, Artificial Sequence
  Description of Artificial Sequence: Synthetic oligonucleotide
  Target: FXN; (+) strand; PAM type: YTN; PAM sequence: CTC
accagctgtggccactgtct

SEQ ID NO: 34599 - DNA, 20 bp, Artificial Sequence
  Description of Artificial Sequence: Synthetic oligonucleotide
  Target: FXN; (+) strand; PAM type: YTN; PAM sequence: CTG
tggccactgtctgtgctaat

SEQ ID NO: 34600 - DNA, 20 bp, Artificial Sequence
  Description of Artificial Sequence: Synthetic oligonucleotide
  Target: FXN; (+) strand; PAM type: YTN; PAM sequence: CTG
tctgtgctaattggctagtg

SEQ ID NO: 34601 - DNA, 20 bp, Artificial Sequence
  Description of Artificial Sequence: Synthetic oligonucleotide
  Target: FXN; (+) strand; PAM type: YTN; PAM sequence: CTG
tgctaattggctagtgcctg

SEQ ID NO: 34602 - DNA, 20 bp, Artificial Sequence
  Description of Artificial Sequence: Synthetic oligonucleotide
  Target: FXN; (+) strand; PAM type: YTN; PAM sequence: CTA
attggctagtgcctgcatct

SEQ ID NO: 34603 - DNA, 20 bp, Artificial Sequence
  Description of Artificial Sequence: Synthetic oligonucleotide
  Target: FXN; (+) strand; PAM type: YTN; PAM sequence: TTG
gctagtgcctgcatctcaga

SEQ ID NO: 34604 - DNA, 20 bp, Artificial Sequence
  Description of Artificial Sequence: Synthetic oligonucleotide
  Target: FXN; (+) strand; PAM type: YTN; PAM sequence: CTA
gtgcctgcatctcagaaact

SEQ ID NO: 34605 - DNA, 20 bp, Artificial Sequence
  Description of Artificial Sequence: Synthetic oligonucleotide
  Target: FXN; (+) strand; PAM type: YTN; PAM sequence: CTG
catctcagaaactgctacat

SEQ ID NO: 34606 - DNA, 20 bp, Artificial Sequence
  Description of Artificial Sequence: Synthetic oligonucleotide
  Target: FXN; (+) strand; PAM type: YTN; PAM sequence: CTC
agaaactgctacatattttg

SEQ ID NO: 34607 - DNA, 20 bp, Artificial Sequence
  Description of Artificial Sequence: Synthetic oligonucleotide
  Target: FXN; (+) strand; PAM type: YTN; PAM sequence: CTG
ctacatattttgactattcc

SEQ ID NO: 34608 - DNA, 20 bp, Artificial Sequence
  Description of Artificial Sequence: Synthetic oligonucleotide
  Target: FXN; (+) strand; PAM type: YTN; PAM sequence: CTA
catattttgactattccccc

SEQ ID NO: 34609 - DNA, 20 bp, Artificial Sequence
  Description of Artificial Sequence: Synthetic oligonucleotide
  Target: FXN; (+) strand; PAM type: YTN; PAM sequence: TTT
tgactattccccctgcactt

SEQ ID NO: 34610 - DNA, 20 bp, Artificial Sequence
  Description of Artificial Sequence: Synthetic oligonucleotide
  Target: FXN; (+) strand; PAM type: YTN; PAM sequence: TTT
gactattccccctgcactta

SEQ ID NO: 34611 - DNA, 20 bp, Artificial Sequence
  Description of Artificial Sequence: Synthetic oligonucleotide
  Target: FXN; (+) strand; PAM type: YTN; PAM sequence: TTG
actattccccctgcacttaa

SEQ ID NO: 34612 - DNA, 20 bp, Artificial Sequence
  Description of Artificial Sequence: Synthetic oligonucleotide
  Target: FXN; (+) strand; PAM type: YTN; PAM sequence: CTA
ttccccctgcacttaagggc

SEQ ID NO: 34613 - DNA, 20 bp, Artificial Sequence
  Description of Artificial Sequence: Synthetic oligonucleotide
  Target: FXN; (+) strand; PAM type: YTN; PAM sequence: TTC
cccctgcacttaagggcatg

SEQ ID NO: 34614 - DNA, 20 bp, Artificial Sequence
  Description of Artificial Sequence: Synthetic oligonucleotide
  Target: FXN; (+) strand; PAM type: YTN; PAM sequence: CTG
cacttaagggcatgcacact

SEQ ID NO: 34615 - DNA, 20 bp, Artificial Sequence
  Description of Artificial Sequence: Synthetic oligonucleotide
  Target: FXN; (+) strand; PAM type: YTN; PAM sequence: CTT
aagggcatgcacactcccaa

SEQ ID NO: 34616 - DNA, 20 bp, Artificial Sequence
  Description of Artificial Sequence: Synthetic oligonucleotide
  Target: FXN; (+) strand; PAM type: YTN; PAM sequence: TTA
agggcatgcacactcccaaa

SEQ ID NO: 34617 - DNA, 20 bp, Artificial Sequence
  Description of Artificial Sequence: Synthetic oligonucleotide
  Target: FXN; (+) strand; PAM type: YTN; PAM sequence: CTC
ccaaaatagactcagattgt

SEQ ID NO: 34618 - DNA, 20 bp, Artificial Sequence
  Description of Artificial Sequence: Synthetic oligonucleotide
  Target: FXN; (+) strand; PAM type: YTN; PAM sequence: CTC
agattgtctaaggaataatg

SEQ ID NO: 34619 - DNA, 20 bp, Artificial Sequence
  Description of Artificial Sequence: Synthetic oligonucleotide
  Target: FXN; (+) strand; PAM type: YTN; PAM sequence: TTG
tctaaggaataatgatgatg

SEQ ID NO: 34620 - DNA, 20 bp, Artificial Sequence
  Description of Artificial Sequence: Synthetic oligonucleotide
  Target: FXN; (+) strand; PAM type: YTN; PAM sequence: CTA
aggaataatgatgatgatga

SEQ ID NO: 34621 - DNA, 20 bp, Artificial Sequence
  Description of Artificial Sequence: Synthetic oligonucleotide
  Target: FXN; (+) strand; PAM type: YTN; PAM sequence: CTC
tttatctggtctatttgtag

SEQ ID NO: 34622 - DNA, 20 bp, Artificial Sequence
  Description of Artificial Sequence: Synthetic oligonucleotide
  Target: FXN; (+) strand; PAM type: YTN; PAM sequence: CTT
tatctggtctatttgtagtc

SEQ ID NO: 34623 - DNA, 20 bp, Artificial Sequence
  Description of Artificial Sequence: Synthetic oligonucleotide
  Target: FXN; (+) strand; PAM type: YTN; PAM sequence: TTT
atctggtctatttgtagtca

SEQ ID NO: 34624 - DNA, 20 bp, Artificial Sequence
  Description of Artificial Sequence: Synthetic oligonucleotide
  Target: FXN; (+) strand; PAM type: YTN; PAM sequence: TTA
tctggtctatttgtagtcag

SEQ ID NO: 34625 - DNA, 20 bp, Artificial Sequence
  Description of Artificial Sequence: Synthetic oligonucleotide
  Target: FXN; (+) strand; PAM type: YTN; PAM sequence: CTG
gtctatttgtagtcagttcc

SEQ ID NO: 34626 - DNA, 20 bp, Artificial Sequence
  Description of Artificial Sequence: Synthetic oligonucleotide
  Target: FXN; (+) strand; PAM type: YTN; PAM sequence: CTA
tttgtagtcagttccaaaag

SEQ ID NO: 34627 - DNA, 20 bp, Artificial Sequence
  Description of Artificial Sequence: Synthetic oligonucleotide
  Target: FXN; (+) strand; PAM type: YTN; PAM sequence: TTT
gtagtcagttccaaaagcat

SEQ ID NO: 34628 - DNA, 20 bp, Artificial Sequence
  Description of Artificial Sequence: Synthetic oligonucleotide
  Target: FXN; (+) strand; PAM type: YTN; PAM sequence: TTG
tagtcagttccaaaagcatt

SEQ ID NO: 34629 - DNA, 20 bp, Artificial Sequence
  Description of Artificial Sequence: Synthetic oligonucleotide
  Target: FXN; (+) strand; PAM type: YTN; PAM sequence: TTC
caaaagcattaagaatttct

SEQ ID NO: 34630 - DNA, 20 bp, Artificial Sequence
  Description of Artificial Sequence: Synthetic oligonucleotide
  Target: FXN; (+) strand; PAM type: YTN; PAM sequence: TTA
agaatttctgctgaactaat

SEQ ID NO: 34631 - DNA, 20 bp, Artificial Sequence
  Description of Artificial Sequence: Synthetic oligonucleotide
  Target: FXN; (+) strand; PAM type: YTN; PAM sequence: TTT
ctgctgaactaatgcagcta

SEQ ID NO: 34632 - DNA, 20 bp, Artificial Sequence
  Description of Artificial Sequence: Synthetic oligonucleotide
  Target: FXN; (+) strand; PAM type: YTN; PAM sequence: TTC
tgctgaactaatgcagctag

SEQ ID NO: 34633 - DNA, 20 bp, Artificial Sequence
  Description of Artificial Sequence: Synthetic oligonucleotide
  Target: FXN; (+) strand; PAM type: YTN; PAM sequence: CTG
ctgaactaatgcagctagtt

SEQ ID NO: 34634 - DNA, 20 bp, Artificial Sequence
  Description of Artificial Sequence: Synthetic oligonucleotide
  Target: FXN; (+) strand; PAM type: YTN; PAM sequence: CTG
aactaatgcagctagtttct

SEQ ID NO: 34635 - DNA, 20 bp, Artificial Sequence
  Description of Artificial Sequence: Synthetic oligonucleotide
  Target: FXN; (+) strand; PAM type: YTN; PAM sequence: CTA
atgcagctagtttctttcct

SEQ ID NO: 34636 - DNA, 20 bp, Artificial Sequence
  Description of Artificial Sequence: Synthetic oligonucleotide
  Target: FXN; (+) strand; PAM type: YTN; PAM sequence: CTA
gtttctttcctgtcaccact

SEQ ID NO: 34637 - DNA, 20 bp, Artificial Sequence
  Description of Artificial Sequence: Synthetic oligonucleotide
  Target: FXN; (+) strand; PAM type: YTN; PAM sequence: TTT
ctttcctgtcaccactttcc

SEQ ID NO: 34638 - DNA, 20 bp, Artificial Sequence
  Description of Artificial Sequence: Synthetic oligonucleotide
  Target: FXN; (+) strand; PAM type: YTN; PAM sequence: TTC
tttcctgtcaccactttcct

SEQ ID NO: 34639 - DNA, 20 bp, Artificial Sequence
  Description of Artificial Sequence: Synthetic oligonucleotide
  Target: FXN; (+) strand; PAM type: YTN; PAM sequence: CTT
tcctgtcaccactttccttc

SEQ ID NO: 34640 - DNA, 20 bp, Artificial Sequence
  Description of Artificial Sequence: Synthetic oligonucleotide
  Target: FXN; (+) strand; PAM type: YTN; PAM sequence: TTT
cctgtcaccactttccttcc

SEQ ID NO: 34641 - DNA, 20 bp, Artificial Sequence
  Description of Artificial Sequence: Synthetic oligonucleotide
  Target: FXN; (+) strand; PAM type: YTN; PAM sequence: TTC
ctgtcaccactttccttcca

SEQ ID NO: 34642 - DNA, 20 bp, Artificial Sequence
  Description of Artificial Sequence: Synthetic oligonucleotide
  Target: FXN; (+) strand; PAM type: YTN; PAM sequence: CTG
tcaccactttccttccaaaa

SEQ ID NO: 34643 - DNA, 20 bp, Artificial Sequence
  Description of Artificial Sequence: Synthetic oligonucleotide
  Target: FXN; (+) strand; PAM type: YTN; PAM sequence: CTT
tccttccaaaatagtttcaa

SEQ ID NO: 34644 - DNA, 20 bp, Artificial Sequence
  Description of Artificial Sequence: Synthetic oligonucleotide
  Target: FXN; (+) strand; PAM type: YTN; PAM sequence: TTT
ccttccaaaatagtttcaag

SEQ ID NO: 34645 - DNA, 20 bp, Artificial Sequence
  Description of Artificial Sequence: Synthetic oligonucleotide
  Target: FXN; (+) strand; PAM type: YTN; PAM sequence: TTC
cttccaaaatagtttcaaga

SEQ ID NO: 34646 - DNA, 20 bp, Artificial Sequence
  Description of Artificial Sequence: Synthetic oligonucleotide
  Target: FXN; (+) strand; PAM type: YTN; PAM sequence: CTT
ccaaaatagtttcaagatct

SEQ ID NO: 34647 - DNA, 20 bp, Artificial Sequence
  Description of Artificial Sequence: Synthetic oligonucleotide
  Target: FXN; (+) strand; PAM type: YTN; PAM sequence: TTC
caaaatagtttcaagatctg

SEQ ID NO: 34648 - DNA, 20 bp, Artificial Sequence
  Description of Artificial Sequence: Synthetic oligonucleotide
  Target: FXN; (+) strand; PAM type: YTN; PAM sequence: TTT
caagatctgtgggggaaaaa

SEQ ID NO: 34649 - DNA, 20 bp, Artificial Sequence
  Description of Artificial Sequence: Synthetic oligonucleotide
  Target: FXN; (+) strand; PAM type: YTN; PAM sequence: TTC
aagatctgtgggggaaaaaa

SEQ ID NO: 34650 - DNA, 20 bp, Artificial Sequence
  Description of Artificial Sequence: Synthetic oligonucleotide
  Target: FXN; (+) strand; PAM type: YTN; PAM sequence: CTG
tgggggaaaaaatctattta

SEQ ID NO: 34651 - DNA, 20 bp, Artificial Sequence
  Description of Artificial Sequence: Synthetic oligonucleotide
  Target: FXN; (+) strand; PAM type: YTN; PAM sequence: CTA
tttacagtgaacagactggt

SEQ ID NO: 34652 - DNA, 20 bp, Artificial Sequence
  Description of Artificial Sequence: Synthetic oligonucleotide
  Target: FXN; (+) strand; PAM type: YTN; PAM sequence: TTT
acagtgaacagactggtggg

SEQ ID NO: 34653 - DNA, 20 bp, Artificial Sequence
  Description of Artificial Sequence: Synthetic oligonucleotide
  Target: FXN; (+) strand; PAM type: YTN; PAM sequence: TTA
cagtgaacagactggtggga

SEQ ID NO: 34654 - DNA, 20 bp, Artificial Sequence
  Description of Artificial Sequence: Synthetic oligonucleotide
  Target: FXN; (+) strand; PAM type: YTN; PAM sequence: CTG
gtgggaggaagttgagcatt

SEQ ID NO: 34655 - DNA, 20 bp, Artificial Sequence
  Description of Artificial Sequence: Synthetic oligonucleotide
  Target: FXN; (+) strand; PAM type: YTN; PAM sequence: TTG
agcattggggttttctgccc

SEQ ID NO: 34656 - DNA, 20 bp, Artificial Sequence
  Description of Artificial Sequence: Synthetic oligonucleotide
  Target: FXN; (+) strand; PAM type: YTN; PAM sequence: TTG
gggttttctgccctgtgtaa

SEQ ID NO: 34657 - DNA, 20 bp, Artificial Sequence
  Description of Artificial Sequence: Synthetic oligonucleotide
  Target: FXN; (+) strand; PAM type: YTN; PAM sequence: TTT
tctgccctgtgtaaccttgc

SEQ ID NO: 34658 - DNA, 20 bp, Artificial Sequence
  Description of Artificial Sequence: Synthetic oligonucleotide
  Target: FXN; (+) strand; PAM type: YTN; PAM sequence: TTT
ctgccctgtgtaaccttgcc

SEQ ID NO: 34659 - DNA, 20 bp, Artificial Sequence
  Description of Artificial Sequence: Synthetic oligonucleotide
  Target: FXN; (+) strand; PAM type: YTN; PAM sequence: TTC
tgccctgtgtaaccttgccc

SEQ ID NO: 34660 - DNA, 20 bp, Artificial Sequence
  Description of Artificial Sequence: Synthetic oligonucleotide
  Target: FXN; (+) strand; PAM type: YTN; PAM sequence: CTG
ccctgtgtaaccttgcccta

SEQ ID NO: 34661 - DNA, 20 bp, Artificial Sequence
  Description of Artificial Sequence: Synthetic oligonucleotide
  Target: FXN; (+) strand; PAM type: YTN; PAM sequence: CTG
tgtaaccttgccctaagttg

SEQ ID NO: 34662 - DNA, 20 bp, Artificial Sequence
  Description of Artificial Sequence: Synthetic oligonucleotide
  Target: FXN; (+) strand; PAM type: YTN; PAM sequence: CTT
gccctaagttgggcagatgg

SEQ ID NO: 34663 - DNA, 20 bp, Artificial Sequence
  Description of Artificial Sequence: Synthetic oligonucleotide
  Target: FXN; (+) strand; PAM type: YTN; PAM sequence: TTG
ccctaagttgggcagatggt

SEQ ID NO: 34664 - DNA, 20 bp, Artificial Sequence
  Description of Artificial Sequence: Synthetic oligonucleotide
  Target: FXN; (+) strand; PAM type: YTN; PAM sequence: CTA
agttgggcagatggtatcac

SEQ ID NO: 34665 - DNA, 20 bp, Artificial Sequence
  Description of Artificial Sequence: Synthetic oligonucleotide
  Target: FXN; (+) strand; PAM type: YTN; PAM sequence: TTG
ggcagatggtatcacactac

SEQ ID NO: 34666 - DNA, 20 bp, Artificial Sequence
  Description of Artificial Sequence: Synthetic oligonucleotide
  Target: FXN; (+) strand; PAM type: YTN; PAM sequence: CTA
cctggacatcatctgctcat

SEQ ID NO: 34667 - DNA, 20 bp, Artificial Sequence
  Description of Artificial Sequence: Synthetic oligonucleotide
  Target: FXN; (+) strand; PAM type: YTN; PAM sequence: CTG
gacatcatctgctcattcac

SEQ ID NO: 34668 - DNA, 20 bp, Artificial Sequence
  Description of Artificial Sequence: Synthetic oligonucleotide
  Target: FXN; (+) strand; PAM type: YTN; PAM sequence: CTG
ctcattcactatttgaccag

SEQ ID NO: 34669 - DNA, 20 bp, Artificial Sequence
  Description of Artificial Sequence: Synthetic oligonucleotide
  Target: FXN; (+) strand; PAM type: YTN; PAM sequence: CTC
attcactatttgaccagttg

SEQ ID NO: 34670 - DNA, 20 bp, Artificial Sequence
  Description of Artificial Sequence: Synthetic oligonucleotide
  Target: FXN; (+) strand; PAM type: YTN; PAM sequence: TTC
actatttgaccagttggtca

SEQ ID NO: 34671 - DNA, 20 bp, Artificial Sequence
  Description of Artificial Sequence: Synthetic oligonucleotide
  Target: FXN; (+) strand; PAM type: YTN; PAM sequence: CTA
tttgaccagttggtcattca

SEQ ID NO: 34672 - DNA, 20 bp, Artificial Sequence
  Description of Artificial Sequence: Synthetic oligonucleotide
  Target: FXN; (+) strand; PAM type: YTN; PAM sequence: TTT
gaccagttggtcattcattc

SEQ ID NO: 34673 - DNA, 20 bp, Artificial Sequence
  Description of Artificial Sequence: Synthetic oligonucleotide
  Target: FXN; (+) strand; PAM type: YTN; PAM sequence: TTG
accagttggtcattcattca

SEQ ID NO: 34674 - DNA, 20 bp, Artificial Sequence
  Description of Artificial Sequence: Synthetic oligonucleotide
  Target: FXN; (+) strand; PAM type: YTN; PAM sequence: TTG
gtcattcattcacaaatgtc

SEQ ID NO: 34675 - DNA, 20 bp, Artificial Sequence
  Description of Artificial Sequence: Synthetic oligonucleotide
  Target: FXN; (+) strand; PAM type: YTN; PAM sequence: TTC
attcacaaatgtcctttttg

SEQ ID NO: 34676 - DNA, 20 bp, Artificial Sequence
  Description of Artificial Sequence: Synthetic oligonucleotide
  Target: FXN; (+) strand; PAM type: YTN; PAM sequence: TTC
acaaatgtcctttttgcagg

SEQ ID NO: 34677 - DNA, 20 bp, Artificial Sequence
  Description of Artificial Sequence: Synthetic oligonucleotide
  Target: FXN; (+) strand; PAM type: YTN; PAM sequence: CTT
tttgcaggagggatggaggt

SEQ ID NO: 34678 - DNA, 20 bp, Artificial Sequence
  Description of Artificial Sequence: Synthetic oligonucleotide
  Target: FXN; (+) strand; PAM type: YTN; PAM sequence: TTT
ttgcaggagggatggaggtg

SEQ ID NO: 34679 - DNA, 20 bp, Artificial Sequence
  Description of Artificial Sequence: Synthetic oligonucleotide
  Target: FXN; (+) strand; PAM type: YTN; PAM sequence: TTT
tgcaggagggatggaggtgc

SEQ ID NO: 34680 - DNA, 20 bp, Artificial Sequence
  Description of Artificial Sequence: Synthetic oligonucleotide
  Target: FXN; (+) strand; PAM type: YTN; PAM sequence: TTT
gcaggagggatggaggtgct

SEQ ID NO: 34681 - DNA, 20 bp, Artificial Sequence
  Description of Artificial Sequence: Synthetic oligonucleotide
  Target: FXN; (+) strand; PAM type: YTN; PAM sequence: TTG
caggagggatggaggtgcta

SEQ ID NO: 34682 - DNA, 20 bp, Artificial Sequence
  Description of Artificial Sequence: Synthetic oligonucleotide
  Target: FXN; (+) strand; PAM type: YTN; PAM sequence: CTA
gacctgcagatgctagcatg

SEQ ID NO: 34683 - DNA, 20 bp, Artificial Sequence
  Description of Artificial Sequence: Synthetic oligonucleotide
  Target: FXN; (+) strand; PAM type: YTN; PAM sequence: CTG
cagatgctagcatgaaaaga

SEQ ID NO: 34684 - DNA, 20 bp, Artificial Sequence
  Description of Artificial Sequence: Synthetic oligonucleotide
  Target: FXN; (+) strand; PAM type: YTN; PAM sequence: CTA
gcatgaaaagacagatctcc

SEQ ID NO: 34685 - DNA, 20 bp, Artificial Sequence
  Description of Artificial Sequence: Synthetic oligonucleotide
  Target: FXN; (+) strand; PAM type: YTN; PAM sequence: CTC
ctgctgctaaggtgcttaaa

SEQ ID NO: 34686 - DNA, 20 bp, Artificial Sequence
  Description of Artificial Sequence: Synthetic oligonucleotide
  Target: FXN; (+) strand; PAM type: YTN; PAM sequence: CTG
ctgctaaggtgcttaaagta

SEQ ID NO: 34687 - DNA, 20 bp, Artificial Sequence
  Description of Artificial Sequence: Synthetic oligonucleotide
  Target: FXN; (+) strand; PAM type: YTN; PAM sequence: CTG
ctaaggtgcttaaagtagtg

SEQ ID NO: 34688 - DNA, 20 bp, Artificial Sequence
  Description of Artificial Sequence: Synthetic oligonucleotide
  Target: FXN; (+) strand; PAM type: YTN; PAM sequence: CTA
aggtgcttaaagtagtggag

SEQ ID NO: 34689 - DNA, 20 bp, Artificial Sequence
  Description of Artificial Sequence: Synthetic oligonucleotide
  Target: FXN; (+) strand; PAM type: YTN; PAM sequence: CTT
aaagtagtggaggtcagggg

SEQ ID NO: 34690 - DNA, 20 bp, Artificial Sequence
  Description of Artificial Sequence: Synthetic oligonucleotide
  Target: FXN; (+) strand; PAM type: YTN; PAM sequence: TTA
aagtagtggaggtcagggga

SEQ ID NO: 34691 - DNA, 20 bp, Artificial Sequence
  Description of Artificial Sequence: Synthetic oligonucleotide
  Target: FXN; (+) strand; PAM type: YTN; PAM sequence: CTC
tgaatgcagaggcaggaagc

SEQ ID NO: 34692 - DNA, 20 bp, Artificial Sequence
  Description of Artificial Sequence: Synthetic oligonucleotide
  Target: FXN; (+) strand; PAM type: YTN; PAM sequence: CTG
aatgcagaggcaggaagcac

SEQ ID NO: 34693 - DNA, 20 bp, Artificial Sequence
  Description of Artificial Sequence: Synthetic oligonucleotide
  Target: FXN; (+) strand; PAM type: YTN; PAM sequence: CTC
atgtggggagggaggaagtt

SEQ ID NO: 34694 - DNA, 20 bp, Artificial Sequence
  Description of Artificial Sequence: Synthetic oligonucleotide
  Target: FXN; (+) strand; PAM type: YTN; PAM sequence: TTG
actgcagagaaggtgccagg

SEQ ID NO: 34695 - DNA, 20 bp, Artificial Sequence
  Description of Artificial Sequence: Synthetic oligonucleotide
  Target: FXN; (+) strand; PAM type: YTN; PAM sequence: CTG
cagagaaggtgccagggggt

SEQ ID NO: 34696 - DNA, 20 bp, Artificial Sequence
  Description of Artificial Sequence: Synthetic oligonucleotide
  Target: FXN; (+) strand; PAM type: YTN; PAM sequence: CTT
gagagctgtggagctagaag

SEQ ID NO: 34697 - DNA, 20 bp, Artificial Sequence
  Description of Artificial Sequence: Synthetic oligonucleotide
  Target: FXN; (+) strand; PAM type: YTN; PAM sequence: TTG
agagctgtggagctagaagg

SEQ ID NO: 34698 - DNA, 20 bp, Artificial Sequence
  Description of Artificial Sequence: Synthetic oligonucleotide
  Target: FXN; (+) strand; PAM type: YTN; PAM sequence: CTG
tggagctagaagggctctca

SEQ ID NO: 34699 - DNA, 20 bp, Artificial Sequence
  Description of Artificial Sequence: Synthetic oligonucleotide
  Target: FXN; (+) strand; PAM type: YTN; PAM sequence: CTA
gaagggctctcacatttgct

SEQ ID NO: 34700 - DNA, 20 bp, Artificial Sequence
  Description of Artificial Sequence: Synthetic oligonucleotide
  Target: FXN; (+) strand; PAM type: YTN; PAM sequence: CTC
tcacatttgcttattaatat

SEQ ID NO: 34701 - DNA, 20 bp, Artificial Sequence
  Description of Artificial Sequence: Synthetic oligonucleotide
  Target: FXN; (+) strand; PAM type: YTN; PAM sequence: CTC
acatttgcttattaatatgc

SEQ ID NO: 34702 - DNA, 20 bp, Artificial Sequence
  Description of Artificial Sequence: Synthetic oligonucleotide
  Target: FXN; (+) strand; PAM type: YTN; PAM sequence: TTT
gcttattaatatgccctttg

SEQ ID NO: 34703 - DNA, 20 bp, Artificial Sequence
  Description of Artificial Sequence: Synthetic oligonucleotide
  Target: FXN; (+) strand; PAM type: YTN; PAM sequence: TTG
cttattaatatgccctttga

SEQ ID NO: 34704 - DNA, 20 bp, Artificial Sequence
  Description of Artificial Sequence: Synthetic oligonucleotide
  Target: FXN; (+) strand; PAM type: YTN; PAM sequence: CTT
attaatatgccctttgaaaa

SEQ ID NO: 34705 - DNA, 20 bp, Artificial Sequence
  Description of Artificial Sequence: Synthetic oligonucleotide
  Target: FXN; (+) strand; PAM type: YTN; PAM sequence: TTA
ttaatatgccctttgaaaaa

SEQ ID NO: 34706 - DNA, 20 bp, Artificial Sequence
  Description of Artificial Sequence: Synthetic oligonucleotide
  Target: FXN; (+) strand; PAM type: YTN; PAM sequence: TTA
atatgccctttgaaaaagag

SEQ ID NO: 34707 - DNA, 20 bp, Artificial Sequence
  Description of Artificial Sequence: Synthetic oligonucleotide
  Target: FXN; (+) strand; PAM type: YTN; PAM sequence: CTT
tgaaaaagagtggcctgata

SEQ ID NO: 34708 - DNA, 20 bp, Artificial Sequence
  Description of Artificial Sequence: Synthetic oligonucleotide
  Target: FXN; (+) strand; PAM type: YTN; PAM sequence: TTT
gaaaaagagtggcctgatac

SEQ ID NO: 34709 - DNA, 20 bp, Artificial Sequence
  Description of Artificial Sequence: Synthetic oligonucleotide
  Target: FXN; (+) strand; PAM type: YTN; PAM sequence: TTG
aaaaagagtggcctgatacc

SEQ ID NO: 34710 - DNA, 20 bp, Artificial Sequence
  Description of Artificial Sequence: Synthetic oligonucleotide
  Target: FXN; (+) strand; PAM type: YTN; PAM sequence: CTG
atacctggagtcactcaaaa

SEQ ID NO: 34711 - DNA, 20 bp, Artificial Sequence
  Description of Artificial Sequence: Synthetic oligonucleotide
  Target: FXN; (+) strand; PAM type: YTN; PAM sequence: CTG
gagtcactcaaaagatttcc

SEQ ID NO: 34712 - DNA, 20 bp, Artificial Sequence
  Description of Artificial Sequence: Synthetic oligonucleotide
  Target: FXN; (+) strand; PAM type: YTN; PAM sequence: CTC
aaaagatttccaattccgat

SEQ ID NO: 34713 - DNA, 20 bp, Artificial Sequence
  Description of Artificial Sequence: Synthetic oligonucleotide
  Target: FXN; (+) strand; PAM type: YTN; PAM sequence: TTT
ccaattccgataggaaaaag

SEQ ID NO: 34714 - DNA, 20 bp, Artificial Sequence
  Description of Artificial Sequence: Synthetic oligonucleotide
  Target: FXN; (+) strand; PAM type: YTN; PAM sequence: TTC
caattccgataggaaaaagt

SEQ ID NO: 34715 - DNA, 20 bp, Artificial Sequence
  Description of Artificial Sequence: Synthetic oligonucleotide
  Target: FXN; (+) strand; PAM type: YTN; PAM sequence: TTC
cgataggaaaaagtcaattt

SEQ ID NO: 34716 - DNA, 20 bp, Artificial Sequence
  Description of Artificial Sequence: Synthetic oligonucleotide
  Target: FXN; (+) strand; PAM type: YTN; PAM sequence: TTT
tggcttcagtggttgcatgt

SEQ ID NO: 34717 - DNA, 20 bp, Artificial Sequence
  Description of Artificial Sequence: Synthetic oligonucleotide
  Target: FXN; (+) strand; PAM type: YTN; PAM sequence: TTT
ggcttcagtggttgcatgtg

SEQ ID NO: 34718 - DNA, 20 bp, Artificial Sequence
  Description of Artificial Sequence: Synthetic oligonucleotide
  Target: FXN; (+) strand; PAM type: YTN; PAM sequence: TTG
gcttcagtggttgcatgtgc

SEQ ID NO: 34719 - DNA, 20 bp, Artificial Sequence
  Description of Artificial Sequence: Synthetic oligonucleotide
  Target: FXN; (+) strand; PAM type: YTN; PAM sequence: CTT
cagtggttgcatgtgcaccc

SEQ ID NO: 34720 - DNA, 20 bp, Artificial Sequence
  Description of Artificial Sequence: Synthetic oligonucleotide
  Target: FXN; (+) strand; PAM type: YTN; PAM sequence: TTC
agtggttgcatgtgcacccc

SEQ ID NO: 34721 - DNA, 20 bp, Artificial Sequence
  Description of Artificial Sequence: Synthetic oligonucleotide
  Target: FXN; (+) strand; PAM type: YTN; PAM sequence: TTG
catgtgcaccccctgatttg

SEQ ID NO: 34722 - DNA, 20 bp, Artificial Sequence
  Description of Artificial Sequence: Synthetic oligonucleotide
  Target: FXN; (+) strand; PAM type: YTN; PAM sequence: CTG
atttgctgtatgctgaggca

SEQ ID NO: 34723 - DNA, 20 bp, Artificial Sequence
  Description of Artificial Sequence: Synthetic oligonucleotide
  Target: FXN; (+) strand; PAM type: YTN; PAM sequence: TTT
gctgtatgctgaggcattgt

SEQ ID NO: 34724 - DNA, 20 bp, Artificial Sequence
  Description of Artificial Sequence: Synthetic oligonucleotide
  Target: FXN; (+) strand; PAM type: YTN; PAM sequence: TTG
ctgtatgctgaggcattgtg

SEQ ID NO: 34725 - DNA, 20 bp, Artificial Sequence
  Description of Artificial Sequence: Synthetic oligonucleotide
  Target: FXN; (+) strand; PAM type: YTN; PAM sequence: CTG
tatgctgaggcattgtggtg

SEQ ID NO: 34726 - DNA, 20 bp, Artificial Sequence
  Description of Artificial Sequence: Synthetic oligonucleotide
  Target: FXN; (+) strand; PAM type: YTN; PAM sequence: CTG
aggcattgtggtgatggacg

SEQ ID NO: 34727 - DNA, 20 bp, Artificial Sequence
  Description of Artificial Sequence: Synthetic oligonucleotide
  Target: FXN; (+) strand; PAM type: YTN; PAM sequence: TTG
tggtgatggacgcaagtgcg

SEQ ID NO: 34728 - DNA, 20 bp, Artificial Sequence
  Description of Artificial Sequence: Synthetic oligonucleotide
  Target: FXN; (+) strand; PAM type: YTN; PAM sequence: CTT
gagcacgcatctgcccctag

SEQ ID NO: 34729 - DNA, 20 bp, Artificial Sequence
  Description of Artificial Sequence: Synthetic oligonucleotide
  Target: FXN; (+) strand; PAM type: YTN; PAM sequence: TTG
agcacgcatctgcccctagt

SEQ ID NO: 34730 - DNA, 20 bp, Artificial Sequence
  Description of Artificial Sequence: Synthetic oligonucleotide
  Target: FXN; (+) strand; PAM type: YTN; PAM sequence: CTG
cccctagttcttgccctgag

SEQ ID NO: 34731 - DNA, 20 bp, Artificial Sequence
  Description of Artificial Sequence: Synthetic oligonucleotide
  Target: FXN; (+) strand; PAM type: YTN; PAM sequence: CTA
gttcttgccctgagtcctcg

SEQ ID NO: 34732 - DNA, 20 bp, Artificial Sequence
  Description of Artificial Sequence: Synthetic oligonucleotide
  Target: FXN; (+) strand; PAM type: YTN; PAM sequence: TTC
ttgccctgagtcctcgaagg

SEQ ID NO: 34733 - DNA, 20 bp, Artificial Sequence
  Description of Artificial Sequence: Synthetic oligonucleotide
  Target: FXN; (+) strand; PAM type: YTN; PAM sequence: CTT
gccctgagtcctcgaaggag

SEQ ID NO: 34734 - DNA, 20 bp, Artificial Sequence
  Description of Artificial Sequence: Synthetic oligonucleotide
  Target: FXN; (+) strand; PAM type: YTN; PAM sequence: TTG
ccctgagtcctcgaaggagg

SEQ ID NO: 34735 - DNA, 20 bp, Artificial Sequence
  Description of Artificial Sequence: Synthetic oligonucleotide
  Target: FXN; (+) strand; PAM type: YTN; PAM sequence: CTG
agtcctcgaaggaggcagga

SEQ ID NO: 34736 - DNA, 20 bp, Artificial Sequence
  Description of Artificial Sequence: Synthetic oligonucleotide
  Target: FXN; (+) strand; PAM type: YTN; PAM sequence: CTC
gaaggaggcaggagagacat

SEQ ID NO: 34737 - DNA, 20 bp, Artificial Sequence
  Description of Artificial Sequence: Synthetic oligonucleotide
  Target: FXN; (+) strand; PAM type: YTN; PAM sequence: CTC
atcagtgatgagaccagacc

SEQ ID NO: 34738 - DNA, 20 bp, Artificial Sequence
  Description of Artificial Sequence: Synthetic oligonucleotide
  Target: FXN; (+) strand; PAM type: YTN; PAM sequence: CTG
gaactcgcgtcttatactca

SEQ ID NO: 34739 - DNA, 20 bp, Artificial Sequence
  Description of Artificial Sequence: Synthetic oligonucleotide
  Target: FXN; (+) strand; PAM type: YTN; PAM sequence: CTC
gcgtcttatactcagtcctc

SEQ ID NO: 34740 - DNA, 20 bp, Artificial Sequence
  Description of Artificial Sequence: Synthetic oligonucleotide
  Target: FXN; (+) strand; PAM type: YTN; PAM sequence: CTT
atactcagtcctctgccctt

SEQ ID NO: 34741 - DNA, 20 bp, Artificial Sequence
  Description of Artificial Sequence: Synthetic oligonucleotide
  Target: FXN; (+) strand; PAM type: YTN; PAM sequence: TTA
tactcagtcctctgcccttt

SEQ ID NO: 34742 - DNA, 20 bp, Artificial Sequence
  Description of Artificial Sequence: Synthetic oligonucleotide
  Target: FXN; (+) strand; PAM type: YTN; PAM sequence: CTC
agtcctctgccctttctgct

SEQ ID NO: 34743 - DNA, 20 bp, Artificial Sequence
  Description of Artificial Sequence: Synthetic oligonucleotide
  Target: FXN; (+) strand; PAM type: YTN; PAM sequence: CTC
tgccctttctgctggattgt

SEQ ID NO: 34744 - DNA, 20 bp, Artificial Sequence
  Description of Artificial Sequence: Synthetic oligonucleotide
  Target: FXN; (+) strand; PAM type: YTN; PAM sequence: CTG
ccctttctgctggattgtgg

SEQ ID NO: 34745 - DNA, 20 bp, Artificial Sequence
  Description of Artificial Sequence: Synthetic oligonucleotide
  Target: FXN; (+) strand; PAM type: YTN; PAM sequence: CTT
tctgctggattgtggccccc

SEQ ID NO: 34746 - DNA, 20 bp, Artificial Sequence
  Description of Artificial Sequence: Synthetic oligonucleotide
  Target: FXN; (+) strand; PAM type: YTN; PAM sequence: TTT
ctgctggattgtggcccccc

SEQ ID NO: 34747 - DNA, 20 bp, Artificial Sequence
  Description of Artificial Sequence: Synthetic oligonucleotide
  Target: FXN; (+) strand; PAM type: YTN; PAM sequence: TTC
tgctggattgtggcccccca

SEQ ID NO: 34748 - DNA, 20 bp, Artificial Sequence
  Description of Artificial Sequence: Synthetic oligonucleotide
  Target: FXN; (+) strand; PAM type: YTN; PAM sequence: CTG
ctggattgtggccccccagt

SEQ ID NO: 34749 - DNA, 20 bp, Artificial Sequence
  Description of Artificial Sequence: Synthetic oligonucleotide
  Target: FXN; (+) strand; PAM type: YTN; PAM sequence: CTG
gattgtggccccccagtata

SEQ ID NO: 34750 - DNA, 20 bp, Artificial Sequence
  Description of Artificial Sequence: Synthetic oligonucleotide
  Target: FXN; (+) strand; PAM type: YTN; PAM sequence: TTG
tggccccccagtatagggtg

SEQ ID NO: 34751 - DNA, 20 bp, Artificial Sequence
  Description of Artificial Sequence: Synthetic oligonucleotide
  Target: FXN; (+) strand; PAM type: YTN; PAM sequence: CTG
gagcatttaagggccacaaa

SEQ ID NO: 34752 - DNA, 20 bp, Artificial Sequence
  Description of Artificial Sequence: Synthetic oligonucleotide
  Target: FXN; (+) strand; PAM type: YTN; PAM sequence: TTT
aagggccacaaagagaacaa

SEQ ID NO: 34753 - DNA, 20 bp, Artificial Sequence
  Description of Artificial Sequence: Synthetic oligonucleotide
  Target: FXN; (+) strand; PAM type: YTN; PAM sequence: TTA
agggccacaaagagaacaaa

SEQ ID NO: 34754 - DNA, 20 bp, Artificial Sequence
  Description of Artificial Sequence: Synthetic oligonucleotide
  Target: FXN; (+) strand; PAM type: YTN; PAM sequence: TTA
ccaatgattgtgtgttgatt

SEQ ID NO: 34755 - DNA, 20 bp, Artificial Sequence
  Description of Artificial Sequence: Synthetic oligonucleotide
  Target: FXN; (+) strand; PAM type: YTN; PAM sequence: TTG
tgtgttgattctttgagctc

SEQ ID NO: 34756 - DNA, 20 bp, Artificial Sequence
  Description of Artificial Sequence: Synthetic oligonucleotide
  Target: FXN; (+) strand; PAM type: YTN; PAM sequence: TTG
attctttgagctcttttttt

SEQ ID NO: 34757 - DNA, 20 bp, Artificial Sequence
  Description of Artificial Sequence: Synthetic oligonucleotide
  Target: FXN; (+) strand; PAM type: YTN; PAM sequence: TTC
tttgagctctttttttttat

SEQ ID NO: 34758 - DNA, 20 bp, Artificial Sequence
  Description of Artificial Sequence: Synthetic oligonucleotide
  Target: FXN; (+) strand; PAM type: YTN; PAM sequence: CTT
tgagctctttttttttatta

SEQ ID NO: 34759 - DNA, 20 bp, Artificial Sequence
  Description of Artificial Sequence: Synthetic oligonucleotide
  Target: FXN; (+) strand; PAM type: YTN; PAM sequence: TTT
gagctctttttttttattat

SEQ ID NO: 34760 - DNA, 20 bp, Artificial Sequence
  Description of Artificial Sequence: Synthetic oligonucleotide
  Target: FXN; (+) strand; PAM type: YTN; PAM sequence: TTG
agctctttttttttattatt

SEQ ID NO: 34761 - DNA, 20 bp, Artificial Sequence
  Description of Artificial Sequence: Synthetic oligonucleotide
  Target: FXN; (+) strand; PAM type: YTN; PAM sequence: CTC
tttttttttattattatact

SEQ ID NO: 34762 - DNA, 20 bp, Artificial Sequence
  Description of Artificial Sequence: Synthetic oligonucleotide
  Target: FXN; (+) strand; PAM type: YTN; PAM sequence: CTT
tttttttattattatacttt

SEQ ID NO: 34763 - DNA, 20 bp, Artificial Sequence
  Description of Artificial Sequence: Synthetic oligonucleotide
  Target: FXN; (+) strand; PAM type: YTN; PAM sequence: TTT
ttttttattattatacttta

SEQ ID NO: 34764 - DNA, 20 bp, Artificial Sequence
  Description of Artificial Sequence: Synthetic oligonucleotide
  Target: FXN; (+) strand; PAM type: YTN; PAM sequence: TTT
tttttattattatactttaa

SEQ ID NO: 34765 - DNA, 20 bp, Artificial Sequence
  Description of Artificial Sequence: Synthetic oligonucleotide
  Target: FXN; (+) strand; PAM type: YTN; PAM sequence: TTT
ttttattattatactttaag

SEQ ID NO: 34766 - DNA, 20 bp, Artificial Sequence
  Description of Artificial Sequence: Synthetic oligonucleotide
  Target: FXN; (+) strand; PAM type: YTN; PAM sequence: TTT
tttattattatactttaagt

SEQ ID NO: 34767 - DNA, 20 bp, Artificial Sequence
  Description of Artificial Sequence: Synthetic oligonucleotide
  Target: FXN; (+) strand; PAM type: YTN; PAM sequence: TTT
ttattattatactttaagtg

SEQ ID NO: 34768 - DNA, 20 bp, Artificial Sequence
  Description of Artificial Sequence: Synthetic oligonucleotide
  Target: FXN; (+) strand; PAM type: YTN; PAM sequence: TTT
tattattatactttaagtgt

SEQ ID NO: 34769 - DNA, 20 bp, Artificial Sequence
  Description of Artificial Sequence: Synthetic oligonucleotide
  Target: FXN; (+) strand; PAM type: YTN; PAM sequence: TTT
attattatactttaagtgtt

SEQ ID NO: 34770 - DNA, 20 bp, Artificial Sequence
  Description of Artificial Sequence: Synthetic oligonucleotide
  Target: FXN; (+) strand; PAM type: YTN; PAM sequence: TTA
ttattatactttaagtgtta

SEQ ID NO: 34771 - DNA, 20 bp, Artificial Sequence
  Description of Artificial Sequence: Synthetic oligonucleotide
  Target: FXN; (+) strand; PAM type: YTN; PAM sequence: TTA
ttatactttaagtgttaggg

SEQ ID NO: 34772 - DNA, 20 bp, Artificial Sequence
  Description of Artificial Sequence: Synthetic oligonucleotide
  Target: FXN; (+) strand; PAM type: YTN; PAM sequence: TTA
tactttaagtgttagggtac

SEQ ID NO: 34773 - DNA, 20 bp, Artificial Sequence
  Description of Artificial Sequence: Synthetic oligonucleotide
  Target: FXN; (+) strand; PAM type: YTN; PAM sequence: CTT
taagtgttagggtacatgtg

SEQ ID NO: 34774 - DNA, 20 bp, Artificial Sequence
  Description of Artificial Sequence: Synthetic oligonucleotide
  Target: FXN; (+) strand; PAM type: YTN; PAM sequence: TTT
aagtgttagggtacatgtgc

SEQ ID NO: 34775 - DNA, 20 bp, Artificial Sequence
  Description of Artificial Sequence: Synthetic oligonucleotide
  Target: FXN; (+) strand; PAM type: YTN; PAM sequence: TTA
agtgttagggtacatgtgca

SEQ ID NO: 34776 - DNA, 20 bp, Artificial Sequence
  Description of Artificial Sequence: Synthetic oligonucleotide
  Target: FXN; (+) strand; PAM type: YTN; PAM sequence: TTA
gggtacatgtgcacaatgtg

SEQ ID NO: 34777 - DNA, 20 bp, Artificial Sequence
  Description of Artificial Sequence: Synthetic oligonucleotide
  Target: FXN; (+) strand; PAM type: YTN; PAM sequence: TTA
gttacatatgtatacatgtg

SEQ ID NO: 34778 - DNA, 20 bp, Artificial Sequence
  Description of Artificial Sequence: Synthetic oligonucleotide
  Target: FXN; (+) strand; PAM type: YTN; PAM sequence: TTA
catatgtatacatgtgccat

SEQ ID NO: 34779 - DNA, 20 bp, Artificial Sequence
  Description of Artificial Sequence: Synthetic oligonucleotide
  Target: FXN; (+) strand; PAM type: YTN; PAM sequence: CTG
gtgtgctgcacccattaact

SEQ ID NO: 34780 - DNA, 20 bp, Artificial Sequence
  Description of Artificial Sequence: Synthetic oligonucleotide
  Target: FXN; (+) strand; PAM type: YTN; PAM sequence: CTG
cacccattaactcgtcattt

SEQ ID NO: 34781 - DNA, 20 bp, Artificial Sequence
  Description of Artificial Sequence: Synthetic oligonucleotide
  Target: FXN; (+) strand; PAM type: YTN; PAM sequence: TTA
actcgtcatttagcattagg

SEQ ID NO: 34782 - DNA, 20 bp, Artificial Sequence
  Description of Artificial Sequence: Synthetic oligonucleotide
  Target: FXN; (+) strand; PAM type: YTN; PAM sequence: CTC
gtcatttagcattaggtata

SEQ ID NO: 34783 - DNA, 20 bp, Artificial Sequence
  Description of Artificial Sequence: Synthetic oligonucleotide
  Target: FXN; (+) strand; PAM type: YTN; PAM sequence: TTT
agcattaggtatagctccta

SEQ ID NO: 34784 - DNA, 20 bp, Artificial Sequence
  Description of Artificial Sequence: Synthetic oligonucleotide
  Target: FXN; (+) strand; PAM type: YTN; PAM sequence: TTA
gcattaggtatagctcctaa

SEQ ID NO: 34785 - DNA, 20 bp, Artificial Sequence
  Description of Artificial Sequence: Synthetic oligonucleotide
  Target: FXN; (+) strand; PAM type: YTN; PAM sequence: TTA
ggtatagctcctaaagctat

SEQ ID NO: 34786 - DNA, 20 bp, Artificial Sequence
  Description of Artificial Sequence: Synthetic oligonucleotide
  Target: FXN; (+) strand; PAM type: YTN; PAM sequence: CTC
ctaaagctatccctcccccc

SEQ ID NO: 34787 - DNA, 20 bp, Artificial Sequence
  Description of Artificial Sequence: Synthetic oligonucleotide
  Target: FXN; (+) strand; PAM type: YTN; PAM sequence: CTA
aagctatccctccccccttc

SEQ ID NO: 34788 - DNA, 20 bp, Artificial Sequence
  Description of Artificial Sequence: Synthetic oligonucleotide
  Target: FXN; (+) strand; PAM type: YTN; PAM sequence: CTA
tccctccccccttccccctc

SEQ ID NO: 34789 - DNA, 20 bp, Artificial Sequence
  Description of Artificial Sequence: Synthetic oligonucleotide
  Target: FXN; (+) strand; PAM type: YTN; PAM sequence: CTC
cccccttccccctccctcca

SEQ ID NO: 34790 - DNA, 20 bp, Artificial Sequence
  Description of Artificial Sequence: Synthetic oligonucleotide
  Target: FXN; (+) strand; PAM type: YTN; PAM sequence: CTT
ccccctccctccaccccaca

SEQ ID NO: 34791 - DNA, 20 bp, Artificial Sequence
  Description of Artificial Sequence: Synthetic oligonucleotide
  Target: FXN; (+) strand; PAM type: YTN; PAM sequence: TTC
cccctccctccaccccacaa

SEQ ID NO: 34792 - DNA, 20 bp, Artificial Sequence
  Description of Artificial Sequence: Synthetic oligonucleotide
  Target: FXN; (+) strand; PAM type: YTN; PAM sequence: CTC
cctccaccccacaacagtcc

SEQ ID NO: 34793 - DNA, 20 bp, Artificial Sequence
  Description of Artificial Sequence: Synthetic oligonucleotide
  Target: FXN; (+) strand; PAM type: YTN; PAM sequence: CTC
caccccacaacagtccccag

SEQ ID NO: 34794 - DNA, 20 bp, Artificial Sequence
  Description of Artificial Sequence: Synthetic oligonucleotide
  Target: FXN; (+) strand; PAM type: YTN; PAM sequence: TTC
cccttcctgtgaccatgtgt

SEQ ID NO: 34795 - DNA, 20 bp, Artificial Sequence
  Description of Artificial Sequence: Synthetic oligonucleotide
  Target: FXN; (+) strand; PAM type: YTN; PAM sequence: CTT
cctgtgaccatgtgttctca

SEQ ID NO: 34796 - DNA, 20 bp, Artificial Sequence
  Description of Artificial Sequence: Synthetic oligonucleotide
  Target: FXN; (+) strand; PAM type: YTN; PAM sequence: TTC
ctgtgaccatgtgttctcat

SEQ ID NO: 34797 - DNA, 20 bp, Artificial Sequence
  Description of Artificial Sequence: Synthetic oligonucleotide
  Target: FXN; (+) strand; PAM type: YTN; PAM sequence: CTG
tgaccatgtgttctcattgt

SEQ ID NO: 34798 - DNA, 20 bp, Artificial Sequence
  Description of Artificial Sequence: Synthetic oligonucleotide
  Target: FXN; (+) strand; PAM type: YTN; PAM sequence: TTC
tcattgttcagttcccacct

SEQ ID NO: 34799 - DNA, 20 bp, Artificial Sequence
  Description of Artificial Sequence: Synthetic oligonucleotide
  Target: FXN; (+) strand; PAM type: YTN; PAM sequence: CTC
attgttcagttcccacctat

SEQ ID NO: 34800 - DNA, 20 bp, Artificial Sequence
  Description of Artificial Sequence: Synthetic oligonucleotide
  Target: FXN; (+) strand; PAM type: YTN; PAM sequence: TTG
ttcagttcccacctatgagt

SEQ ID NO: 34801 - DNA, 20 bp, Artificial Sequence
  Description of Artificial Sequence: Synthetic oligonucleotide
  Target: FXN; (+) strand; PAM type: YTN; PAM sequence: TTC
agttcccacctatgagtgag

SEQ ID NO: 34802 - DNA, 20 bp, Artificial Sequence
  Description of Artificial Sequence: Synthetic oligonucleotide
  Target: FXN; (+) strand; PAM type: YTN; PAM sequence: TTC
ccacctatgagtgagaatat

SEQ ID NO: 34803 - DNA, 20 bp, Artificial Sequence
  Description of Artificial Sequence: Synthetic oligonucleotide
  Target: FXN; (+) strand; PAM type: YTN; PAM sequence: CTA
tgagtgagaatatgcagtgt

SEQ ID NO: 34804 - DNA, 20 bp, Artificial Sequence
  Description of Artificial Sequence: Synthetic oligonucleotide
  Target: FXN; (+) strand; PAM type: YTN; PAM sequence: TTT
gattttttgttcttgcgata

SEQ ID NO: 34805 - DNA, 20 bp, Artificial Sequence
  Description of Artificial Sequence: Synthetic oligonucleotide
  Target: FXN; (+) strand; PAM type: YTN; PAM sequence: TTG
attttttgttcttgcgatag

SEQ ID NO: 34806 - DNA, 20 bp, Artificial Sequence
  Description of Artificial Sequence: Synthetic oligonucleotide
  Target: FXN; (+) strand; PAM type: YTN; PAM sequence: TTT
tttgttcttgcgatagttta

SEQ ID NO: 34807 - DNA, 20 bp, Artificial Sequence
  Description of Artificial Sequence: Synthetic oligonucleotide
  Target: FXN; (+) strand; PAM type: YTN; PAM sequence: TTT
ttgttcttgcgatagtttac

SEQ ID NO: 34808 - DNA, 20 bp, Artificial Sequence
  Description of Artificial Sequence: Synthetic oligonucleotide
  Target: FXN; (+) strand; PAM type: YTN; PAM sequence: TTT
tgttcttgcgatagtttact

SEQ ID NO: 34809 - DNA, 20 bp, Artificial Sequence
  Description of Artificial Sequence: Synthetic oligonucleotide
  Target: FXN; (+) strand; PAM type: YTN; PAM sequence: TTT
gttcttgcgatagtttactg

SEQ ID NO: 34810 - DNA, 20 bp, Artificial Sequence
  Description of Artificial Sequence: Synthetic oligonucleotide
  Target: FXN; (+) strand; PAM type: YTN; PAM sequence: TTG
ttcttgcgatagtttactga

SEQ ID NO: 34811 - DNA, 20 bp, Artificial Sequence
  Description of Artificial Sequence: Synthetic oligonucleotide
  Target: FXN; (+) strand; PAM type: YTN; PAM sequence: TTC
ttgcgatagtttactgagaa

SEQ ID NO: 34812 - DNA, 20 bp, Artificial Sequence
  Description of Artificial Sequence: Synthetic oligonucleotide
  Target: FXN; (+) strand; PAM type: YTN; PAM sequence: CTT
gcgatagtttactgagaatg

SEQ ID NO: 34813 - DNA, 20 bp, Artificial Sequence
  Description of Artificial Sequence: Synthetic oligonucleotide
  Target: FXN; (+) strand; PAM type: YTN; PAM sequence: TTG
cgatagtttactgagaatga

SEQ ID NO: 34814 - DNA, 20 bp, Artificial Sequence
  Description of Artificial Sequence: Synthetic oligonucleotide
  Target: FXN; (+) strand; PAM type: YTN; PAM sequence: TTT
actgagaatgatgatttcca

SEQ ID NO: 34815 - DNA, 20 bp, Artificial Sequence
  Description of Artificial Sequence: Synthetic oligonucleotide
  Target: FXN; (+) strand; PAM type: YTN; PAM sequence: TTA
ctgagaatgatgatttccag

SEQ ID NO: 34816 - DNA, 20 bp, Artificial Sequence
  Description of Artificial Sequence: Synthetic oligonucleotide
  Target: FXN; (+) strand; PAM type: YTN; PAM sequence: CTG
agaatgatgatttccagttt

SEQ ID NO: 34817 - DNA, 20 bp, Artificial Sequence
  Description of Artificial Sequence: Synthetic oligonucleotide
  Target: FXN; (+) strand; PAM type: YTN; PAM sequence: TTT
ccagtttcatccatgtccct

SEQ ID NO: 34818 - DNA, 20 bp, Artificial Sequence
  Description of Artificial Sequence: Synthetic oligonucleotide
  Target: FXN; (+) strand; PAM type: YTN; PAM sequence: TTC
cagtttcatccatgtcccta

SEQ ID NO: 34819 - DNA, 20 bp, Artificial Sequence
  Description of Artificial Sequence: Synthetic oligonucleotide
  Target: FXN; (+) strand; PAM type: YTN; PAM sequence: TTT
catccatgtccctacaaagg

SEQ ID NO: 34820 - DNA, 20 bp, Artificial Sequence
  Description of Artificial Sequence: Synthetic oligonucleotide
  Target: FXN; (+) strand; PAM type: YTN; PAM sequence: TTC
atccatgtccctacaaagga

SEQ ID NO: 34821 - DNA, 20 bp, Artificial Sequence
  Description of Artificial Sequence: Synthetic oligonucleotide
  Target: FXN; (+) strand; PAM type: YTN; PAM sequence: CTA
caaaggacatgaactcatca

SEQ ID NO: 34822 - DNA, 20 bp, Artificial Sequence
  Description of Artificial Sequence: Synthetic oligonucleotide
  Target: FXN; (+) strand; PAM type: YTN; PAM sequence: CTC
atcattttttattgctgcat

SEQ ID NO: 34823 - DNA, 20 bp, Artificial Sequence
  Description of Artificial Sequence: Synthetic oligonucleotide
  Target: FXN; (+) strand; PAM type: YTN; PAM sequence: TTT
tttattgctgcatagtattc

SEQ ID NO: 34824 - DNA, 20 bp, Artificial Sequence
  Description of Artificial Sequence: Synthetic oligonucleotide
  Target: FXN; (+) strand; PAM type: YTN; PAM sequence: TTT
ttattgctgcatagtattcc

SEQ ID NO: 34825 - DNA, 20 bp, Artificial Sequence
  Description of Artificial Sequence: Synthetic oligonucleotide
  Target: FXN; (+) strand; PAM type: YTN; PAM sequence: TTT
tattgctgcatagtattcca

SEQ ID NO: 34826 - DNA, 20 bp, Artificial Sequence
  Description of Artificial Sequence: Synthetic oligonucleotide
  Target: FXN; (+) strand; PAM type: YTN; PAM sequence: TTT
attgctgcatagtattccat

SEQ ID NO: 34827 - DNA, 20 bp, Artificial Sequence
  Description of Artificial Sequence: Synthetic oligonucleotide
  Target: FXN; (+) strand; PAM type: YTN; PAM sequence: TTA
ttgctgcatagtattccatg

SEQ ID NO: 34828 - DNA, 20 bp, Artificial Sequence
  Description of Artificial Sequence: Synthetic oligonucleotide
  Target: FXN; (+) strand; PAM type: YTN; PAM sequence: TTG
ctgcatagtattccatggtg

SEQ ID NO: 34829 - DNA, 20 bp, Artificial Sequence
  Description of Artificial Sequence: Synthetic oligonucleotide
  Target: FXN; (+) strand; PAM type: YTN; PAM sequence: CTG
catagtattccatggtgtat

SEQ ID NO: 34830 - DNA, 20 bp, Artificial Sequence
  Description of Artificial Sequence: Synthetic oligonucleotide
  Target: FXN; (+) strand; PAM type: YTN; PAM sequence: TTC
catggtgtatatgtgccaca

SEQ ID NO: 34831 - DNA, 20 bp, Artificial Sequence
  Description of Artificial Sequence: Synthetic oligonucleotide
  Target: FXN; (+) strand; PAM type: YTN; PAM sequence: TTT
tcttaatccagtctatcatt

SEQ ID NO: 34832 - DNA, 20 bp, Artificial Sequence
  Description of Artificial Sequence: Synthetic oligonucleotide
  Target: FXN; (+) strand; PAM type: YTN; PAM sequence: TTT
cttaatccagtctatcattg

SEQ ID NO: 34833 - DNA, 20 bp, Artificial Sequence
  Description of Artificial Sequence: Synthetic oligonucleotide
  Target: FXN; (+) strand; PAM type: YTN; PAM sequence: TTC
ttaatccagtctatcattgt

SEQ ID NO: 34834 - DNA, 20 bp, Artificial Sequence
  Description of Artificial Sequence: Synthetic oligonucleotide
  Target: FXN; (+) strand; PAM type: YTN; PAM sequence: CTT
aatccagtctatcattgttg

SEQ ID NO: 34835 - DNA, 20 bp, Artificial Sequence
  Description of Artificial Sequence: Synthetic oligonucleotide
  Target: FXN; (+) strand; PAM type: YTN; PAM sequence: TTA
atccagtctatcattgttgg

SEQ ID NO: 34836 - DNA, 20 bp, Artificial Sequence
  Description of Artificial Sequence: Synthetic oligonucleotide
  Target: FXN; (+) strand; PAM type: YTN; PAM sequence: CTA
tcattgttggatgagctctt

SEQ ID NO: 34837 - DNA, 20 bp, Artificial Sequence
  Description of Artificial Sequence: Synthetic oligonucleotide
  Target: FXN; (+) strand; PAM type: YTN; PAM sequence: TTG
ttggatgagctctttatctc

SEQ ID NO: 34838 - DNA, 20 bp, Artificial Sequence
  Description of Artificial Sequence: Synthetic oligonucleotide
  Target: FXN; (+) strand; PAM type: YTN; PAM sequence: TTG
gatgagctctttatctcatg

SEQ ID NO: 34839 - DNA, 20 bp, Artificial Sequence
  Description of Artificial Sequence: Synthetic oligonucleotide
  Target: FXN; (+) strand; PAM type: YTN; PAM sequence: CTC
tttatctcatggaaaaataa

SEQ ID NO: 34840 - DNA, 20 bp, Artificial Sequence
  Description of Artificial Sequence: Synthetic oligonucleotide
  Target: FXN; (+) strand; PAM type: YTN; PAM sequence: CTT
tatctcatggaaaaataatt

SEQ ID NO: 34841 - DNA, 20 bp, Artificial Sequence
  Description of Artificial Sequence: Synthetic oligonucleotide
  Target: FXN; (+) strand; PAM type: YTN; PAM sequence: TTT
atctcatggaaaaataattt

SEQ ID NO: 34842 - DNA, 20 bp, Artificial Sequence
  Description of Artificial Sequence: Synthetic oligonucleotide
  Target: FXN; (+) strand; PAM type: YTN; PAM sequence: TTA
tctcatggaaaaataattta

SEQ ID NO: 34843 - DNA, 20 bp, Artificial Sequence
  Description of Artificial Sequence: Synthetic oligonucleotide
  Target: FXN; (+) strand; PAM type: YTN; PAM sequence: CTC
atggaaaaataatttataaa

SEQ ID NO: 34844 - DNA, 20 bp, Artificial Sequence
  Description of Artificial Sequence: Synthetic oligonucleotide
  Target: FXN; (+) strand; PAM type: YTN; PAM sequence: TTT
ataaaactctgtatgagagg

SEQ ID NO: 34845 - DNA, 20 bp, Artificial Sequence
  Description of Artificial Sequence: Synthetic oligonucleotide
  Target: FXN; (+) strand; PAM type: YTN; PAM sequence: TTA
taaaactctgtatgagagga

SEQ ID NO: 34846 - DNA, 20 bp, Artificial Sequence
  Description of Artificial Sequence: Synthetic oligonucleotide
  Target: FXN; (+) strand; PAM type: YTN; PAM sequence: CTC
tgtatgagaggagtgggaaa

SEQ ID NO: 34847 - DNA, 20 bp, Artificial Sequence
  Description of Artificial Sequence: Synthetic oligonucleotide
  Target: FXN; (+) strand; PAM type: YTN; PAM sequence: CTG
tatgagaggagtgggaaata

SEQ ID NO: 34848 - DNA, 20 bp, Artificial Sequence
  Description of Artificial Sequence: Synthetic oligonucleotide
  Target: FXN; (+) strand; PAM type: YTN; PAM sequence: TTA
acgggtgcggggtttctttt

SEQ ID NO: 34849 - DNA, 20 bp, Artificial Sequence
  Description of Artificial Sequence: Synthetic oligonucleotide
  Target: FXN; (+) strand; PAM type: YTN; PAM sequence: TTT
ctttttgggacaatggaaat

SEQ ID NO: 34850 - DNA, 20 bp, Artificial Sequence
  Description of Artificial Sequence: Synthetic oligonucleotide
  Target: FXN; (+) strand; PAM type: YTN; PAM sequence: TTC
tttttgggacaatggaaata

SEQ ID NO: 34851 - DNA, 20 bp, Artificial Sequence
  Description of Artificial Sequence: Synthetic oligonucleotide
  Target: FXN; (+) strand; PAM type: YTN; PAM sequence: CTT
tttgggacaatggaaatagc

SEQ ID NO: 34852 - DNA, 20 bp, Artificial Sequence
  Description of Artificial Sequence: Synthetic oligonucleotide
  Target: FXN; (+) strand; PAM type: YTN; PAM sequence: TTT
ttgggacaatggaaatagct

SEQ ID NO: 34853 - DNA, 20 bp, Artificial Sequence
  Description of Artificial Sequence: Synthetic oligonucleotide
  Target: FXN; (+) strand; PAM type: YTN; PAM sequence: TTT
tgggacaatggaaatagctg

SEQ ID NO: 34854 - DNA, 20 bp, Artificial Sequence
  Description of Artificial Sequence: Synthetic oligonucleotide
  Target: FXN; (+) strand; PAM type: YTN; PAM sequence: TTT
gggacaatggaaatagctgg

SEQ ID NO: 34855 - DNA, 20 bp, Artificial Sequence
  Description of Artificial Sequence: Synthetic oligonucleotide
  Target: FXN; (+) strand; PAM type: YTN; PAM sequence: TTG
ggacaatggaaatagctgga

SEQ ID NO: 34856 - DNA, 20 bp, Artificial Sequence
  Description of Artificial Sequence: Synthetic oligonucleotide
  Target: FXN; (+) strand; PAM type: YTN; PAM sequence: CTG
gaattagatagtggtgatgt

SEQ ID NO: 34857 - DNA, 20 bp, Artificial Sequence
  Description of Artificial Sequence: Synthetic oligonucleotide
  Target: FXN; (+) strand; PAM type: YTN; PAM sequence: TTA
gatagtggtgatgtttgcac

SEQ ID NO: 34858 - DNA, 20 bp, Artificial Sequence
  Description of Artificial Sequence: Synthetic oligonucleotide
  Target: FXN; (+) strand; PAM type: YTN; PAM sequence: TTT
gcacactttgtgaaatacta

SEQ ID NO: 34859 - DNA, 20 bp, Artificial Sequence
  Description of Artificial Sequence: Synthetic oligonucleotide
  Target: FXN; (+) strand; PAM type: YTN; PAM sequence: TTG
cacactttgtgaaatactaa

SEQ ID NO: 34860 - DNA, 20 bp, Artificial Sequence
  Description of Artificial Sequence: Synthetic oligonucleotide
  Target: FXN; (+) strand; PAM type: YTN; PAM sequence: CTT
tgtgaaatactaaaaactcc

SEQ ID NO: 34861 - DNA, 20 bp, Artificial Sequence
  Description of Artificial Sequence: Synthetic oligonucleotide
  Target: FXN; (+) strand; PAM type: YTN; PAM sequence: TTT
gtgaaatactaaaaactcct

SEQ ID NO: 34862 - DNA, 20 bp, Artificial Sequence
  Description of Artificial Sequence: Synthetic oligonucleotide
  Target: FXN; (+) strand; PAM type: YTN; PAM sequence: TTG
tgaaatactaaaaactcctg

SEQ ID NO: 34863 - DNA, 20 bp, Artificial Sequence
  Description of Artificial Sequence: Synthetic oligonucleotide
  Target: FXN; (+) strand; PAM type: YTN; PAM sequence: CTA
aaaactcctgaattatacag

SEQ ID NO: 34864 - DNA, 20 bp, Artificial Sequence
  Description of Artificial Sequence: Synthetic oligonucleotide
  Target: FXN; (+) strand; PAM type: YTN; PAM sequence: CTC
ctgaattatacagttttaag

SEQ ID NO: 34865 - DNA, 20 bp, Artificial Sequence
  Description of Artificial Sequence: Synthetic oligonucleotide
  Target: FXN; (+) strand; PAM type: YTN; PAM sequence: CTG
aattatacagttttaagaaa

SEQ ID NO: 34866 - DNA, 20 bp, Artificial Sequence
  Description of Artificial Sequence: Synthetic oligonucleotide
  Target: FXN; (+) strand; PAM type: YTN; PAM sequence: TTA
tacagttttaagaaactttt

SEQ ID NO: 34867 - DNA, 20 bp, Artificial Sequence
  Description of Artificial Sequence: Synthetic oligonucleotide
  Target: FXN; (+) strand; PAM type: YTN; PAM sequence: TTT
taagaaacttttatttattt

SEQ ID NO: 34868 - DNA, 20 bp, Artificial Sequence
  Description of Artificial Sequence: Synthetic oligonucleotide
  Target: FXN; (+) strand; PAM type: YTN; PAM sequence: TTT
aagaaacttttatttatttg

SEQ ID NO: 34869 - DNA, 20 bp, Artificial Sequence
  Description of Artificial Sequence: Synthetic oligonucleotide
  Target: FXN; (+) strand; PAM type: YTN; PAM sequence: TTA
agaaacttttatttatttgt

SEQ ID NO: 34870 - DNA, 20 bp, Artificial Sequence
  Description of Artificial Sequence: Synthetic oligonucleotide
  Target: FXN; (+) strand; PAM type: YTN; PAM sequence: CTT
ttatttatttgtttttgaga

SEQ ID NO: 34871 - DNA, 20 bp, Artificial Sequence
  Description of Artificial Sequence: Synthetic oligonucleotide
  Target: FXN; (+) strand; PAM type: YTN; PAM sequence: TTT
tatttatttgtttttgagag

SEQ ID NO: 34872 - DNA, 20 bp, Artificial Sequence
  Description of Artificial Sequence: Synthetic oligonucleotide
  Target: FXN; (+) strand; PAM type: YTN; PAM sequence: TTT
atttatttgtttttgagaga

SEQ ID NO: 34873 - DNA, 20 bp, Artificial Sequence
  Description of Artificial Sequence: Synthetic oligonucleotide
  Target: FXN; (+) strand; PAM type: YTN; PAM sequence: TTA
tttatttgtttttgagagaa

SEQ ID NO: 34874 - DNA, 20 bp, Artificial Sequence
  Description of Artificial Sequence: Synthetic oligonucleotide
  Target: FXN; (+) strand; PAM type: YTN; PAM sequence: TTT
atttgtttttgagagaagtt

SEQ ID NO: 34875 - DNA, 20 bp, Artificial Sequence
  Description of Artificial Sequence: Synthetic oligonucleotide
  Target: FXN; (+) strand; PAM type: YTN; PAM sequence: TTA
tttgtttttgagagaagttc

SEQ ID NO: 34876 - DNA, 20 bp, Artificial Sequence
  Description of Artificial Sequence: Synthetic oligonucleotide
  Target: FXN; (+) strand; PAM type: YTN; PAM sequence: TTT
gtttttgagagaagttctct

SEQ ID NO: 34877 - DNA, 20 bp, Artificial Sequence
  Description of Artificial Sequence: Synthetic oligonucleotide
  Target: FXN; (+) strand; PAM type: YTN; PAM sequence: TTG
tttttgagagaagttctctg

SEQ ID NO: 34878 - DNA, 20 bp, Artificial Sequence
  Description of Artificial Sequence: Synthetic oligonucleotide
  Target: FXN; (+) strand; PAM type: YTN; PAM sequence: TTT
ttgagagaagttctctgtgt

SEQ ID NO: 34879 - DNA, 20 bp, Artificial Sequence
  Description of Artificial Sequence: Synthetic oligonucleotide
  Target: FXN; (+) strand; PAM type: YTN; PAM sequence: TTT
tgagagaagttctctgtgtc

SEQ ID NO: 34880 - DNA, 20 bp, Artificial Sequence
  Description of Artificial Sequence: Synthetic oligonucleotide
  Target: FXN; (+) strand; PAM type: YTN; PAM sequence: TTT
gagagaagttctctgtgtca

SEQ ID NO: 34881 - DNA, 20 bp, Artificial Sequence
  Description of Artificial Sequence: Synthetic oligonucleotide
  Target: FXN; (+) strand; PAM type: YTN; PAM sequence: TTG
agagaagttctctgtgtcac

SEQ ID NO: 34882 - DNA, 20 bp, Artificial Sequence
  Description of Artificial Sequence: Synthetic oligonucleotide
  Target: FXN; (+) strand; PAM type: YTN; PAM sequence: TTC
tctgtgtcacccaggctgaa

SEQ ID NO: 34883 - DNA, 20 bp, Artificial Sequence
  Description of Artificial Sequence: Synthetic oligonucleotide
  Target: FXN; (+) strand; PAM type: YTN; PAM sequence: CTC
tgtgtcacccaggctgaagt

SEQ ID NO: 34884 - DNA, 20 bp, Artificial Sequence
  Description of Artificial Sequence: Synthetic oligonucleotide
  Target: FXN; (+) strand; PAM type: YTN; PAM sequence: CTG
tgtcacccaggctgaagtgt

SEQ ID NO: 34885 - DNA, 20 bp, Artificial Sequence
  Description of Artificial Sequence: Synthetic oligonucleotide
  Target: FXN; (+) strand; PAM type: YTN; PAM sequence: CTG
aagtgtggtggcgtgatcac

SEQ ID NO: 34886 - DNA, 20 bp, Artificial Sequence
  Description of Artificial Sequence: Synthetic oligonucleotide
  Target: FXN; (+) strand; PAM type: YTN; PAM sequence: TTA
ttgcagcctcaatctctgag

SEQ ID NO: 34887 - DNA, 20 bp, Artificial Sequence
  Description of Artificial Sequence: Synthetic oligonucleotide
  Target: FXN; (+) strand; PAM type: YTN; PAM sequence: TTG
cagcctcaatctctgaggct

SEQ ID NO: 34888 - DNA, 20 bp, Artificial Sequence
  Description of Artificial Sequence: Synthetic oligonucleotide
  Target: FXN; (+) strand; PAM type: YTN; PAM sequence: CTC
aatctctgaggctcaagcga

SEQ ID NO: 34889 - DNA, 20 bp, Artificial Sequence
  Description of Artificial Sequence: Synthetic oligonucleotide
  Target: FXN; (+) strand; PAM type: YTN; PAM sequence: CTC
tgaggctcaagcgattctcc

SEQ ID NO: 34890 - DNA, 20 bp, Artificial Sequence
  Description of Artificial Sequence: Synthetic oligonucleotide
  Target: FXN; (+) strand; PAM type: YTN; PAM sequence: CTG
aggctcaagcgattctccca

SEQ ID NO: 34891 - DNA, 20 bp, Artificial Sequence
  Description of Artificial Sequence: Synthetic oligonucleotide
  Target: FXN; (+) strand; PAM type: YTN; PAM sequence: CTC
aagcgattctcccacctcag

SEQ ID NO: 34892 - DNA, 20 bp, Artificial Sequence
  Description of Artificial Sequence: Synthetic oligonucleotide
  Target: FXN; (+) strand; PAM type: YTN; PAM sequence: TTC
tcccacctcagcctaccaag

SEQ ID NO: 34893 - DNA, 20 bp, Artificial Sequence
  Description of Artificial Sequence: Synthetic oligonucleotide
  Target: FXN; (+) strand; PAM type: YTN; PAM sequence: CTC
ccacctcagcctaccaagta

SEQ ID NO: 34894 - DNA, 20 bp, Artificial Sequence
  Description of Artificial Sequence: Synthetic oligonucleotide
  Target: FXN; (+) strand; PAM type: YTN; PAM sequence: CTC
agcctaccaagtagatgtga

SEQ ID NO: 34895 - DNA, 20 bp, Artificial Sequence
  Description of Artificial Sequence: Synthetic oligonucleotide
  Target: FXN; (+) strand; PAM type: YTN; PAM sequence: CTA
ccaagtagatgtgactatag

SEQ ID NO: 34896 - DNA, 20 bp, Artificial Sequence
  Description of Artificial Sequence: Synthetic oligonucleotide
  Target: FXN; (+) strand; PAM type: YTN; PAM sequence: CTA
taggtgcgcaccaccacacc

SEQ ID NO: 34897 - DNA, 20 bp, Artificial Sequence
  Description of Artificial Sequence: Synthetic oligonucleotide
  Target: FXN; (+) strand; PAM type: YTN; PAM sequence: TTT
gtaattttttgtaaaaacaa

SEQ ID NO: 34898 - DNA, 20 bp, Artificial Sequence
  Description of Artificial Sequence: Synthetic oligonucleotide
  Target: FXN; (+) strand; PAM type: YTN; PAM sequence: TTG
taattttttgtaaaaacaag

SEQ ID NO: 34899 - DNA, 20 bp, Artificial Sequence
  Description of Artificial Sequence: Synthetic oligonucleotide
  Target: FXN; (+) strand; PAM type: YTN; PAM sequence: TTT
tttgtaaaaacaaggtttta

SEQ ID NO: 34900 - DNA, 20 bp, Artificial Sequence
  Description of Artificial Sequence: Synthetic oligonucleotide
  Target: FXN; (+) strand; PAM type: YTN; PAM sequence: TTT
ttgtaaaaacaaggttttac

SEQ ID NO: 34901 - DNA, 20 bp, Artificial Sequence
  Description of Artificial Sequence: Synthetic oligonucleotide
  Target: FXN; (+) strand; PAM type: YTN; PAM sequence: TTT
tgtaaaaacaaggttttacc

SEQ ID NO: 34902 - DNA, 20 bp, Artificial Sequence
  Description of Artificial Sequence: Synthetic oligonucleotide
  Target: FXN; (+) strand; PAM type: YTN; PAM sequence: TTT
gtaaaaacaaggttttacca

SEQ ID NO: 34903 - DNA, 20 bp, Artificial Sequence
  Description of Artificial Sequence: Synthetic oligonucleotide
  Target: FXN; (+) strand; PAM type: YTN; PAM sequence: TTG
taaaaacaaggttttaccat

SEQ ID NO: 34904 - DNA, 20 bp, Artificial Sequence
  Description of Artificial Sequence: Synthetic oligonucleotide
  Target: FXN; (+) strand; PAM type: YTN; PAM sequence: TTT
taccatgttgcccagtctgg

SEQ ID NO: 34905 - DNA, 20 bp, Artificial Sequence
  Description of Artificial Sequence: Synthetic oligonucleotide
  Target: FXN; (+) strand; PAM type: YTN; PAM sequence: TTT
accatgttgcccagtctggt

SEQ ID NO: 34906 - DNA, 20 bp, Artificial Sequence
  Description of Artificial Sequence: Synthetic oligonucleotide
  Target: FXN; (+) strand; PAM type: YTN; PAM sequence: TTA
ccatgttgcccagtctggtc

SEQ ID NO: 34907 - DNA, 20 bp, Artificial Sequence
  Description of Artificial Sequence: Synthetic oligonucleotide
  Target: FXN; (+) strand; PAM type: YTN; PAM sequence: TTG
cccagtctggtcttgaactc

SEQ ID NO: 34908 - DNA, 20 bp, Artificial Sequence
  Description of Artificial Sequence: Synthetic oligonucleotide
  Target: FXN; (+) strand; PAM type: YTN; PAM sequence: CTG
gtcttgaactcctgggccca

SEQ ID NO: 34909 - DNA, 20 bp, Artificial Sequence
  Description of Artificial Sequence: Synthetic oligonucleotide
  Target: FXN; (+) strand; PAM type: YTN; PAM sequence: CTT
gaactcctgggcccaagcga

SEQ ID NO: 34910 - DNA, 20 bp, Artificial Sequence
  Description of Artificial Sequence: Synthetic oligonucleotide
  Target: FXN; (+) strand; PAM type: YTN; PAM sequence: TTG
aactcctgggcccaagcgat

SEQ ID NO: 34911 - DNA, 20 bp, Artificial Sequence
  Description of Artificial Sequence: Synthetic oligonucleotide
  Target: FXN; (+) strand; PAM type: YTN; PAM sequence: CTC
ctgggcccaagcgatcctcc

SEQ ID NO: 34912 - DNA, 20 bp, Artificial Sequence
  Description of Artificial Sequence: Synthetic oligonucleotide
  Target: FXN; (+) strand; PAM type: YTN; PAM sequence: CTG
ggcccaagcgatcctccctc

SEQ ID NO: 34913 - DNA, 20 bp, Artificial Sequence
  Description of Artificial Sequence: Synthetic oligonucleotide
  Target: FXN; (+) strand; PAM type: YTN; PAM sequence: CTC
cctccttgggctcccgaagt

SEQ ID NO: 34914 - DNA, 20 bp, Artificial Sequence
  Description of Artificial Sequence: Synthetic oligonucleotide
  Target: FXN; (+) strand; PAM type: YTN; PAM sequence: CTC
cttgggctcccgaagtgcca

SEQ ID NO: 34915 - DNA, 20 bp, Artificial Sequence
  Description of Artificial Sequence: Synthetic oligonucleotide
  Target: FXN; (+) strand; PAM type: YTN; PAM sequence: CTT
gggctcccgaagtgccagga

SEQ ID NO: 34916 - DNA, 20 bp, Artificial Sequence
  Description of Artificial Sequence: Synthetic oligonucleotide
  Target: FXN; (+) strand; PAM type: YTN; PAM sequence: TTG
ggctcccgaagtgccaggat

SEQ ID NO: 34917 - DNA, 20 bp, Artificial Sequence
  Description of Artificial Sequence: Synthetic oligonucleotide
  Target: FXN; (+) strand; PAM type: YTN; PAM sequence: CTC
ccgaagtgccaggatacaag

SEQ ID NO: 34918 - DNA, 20 bp, Artificial Sequence
  Description of Artificial Sequence: Synthetic oligonucleotide
  Target: FXN; (+) strand; PAM type: YTN; PAM sequence: CTC
agttttaagaaacttttaaa

SEQ ID NO: 34919 - DNA, 20 bp, Artificial Sequence
  Description of Artificial Sequence: Synthetic oligonucleotide
  Target: FXN; (+) strand; PAM type: YTN; PAM sequence: TTT
taagaaacttttaaataaat

SEQ ID NO: 34920 - DNA, 20 bp, Artificial Sequence
  Description of Artificial Sequence: Synthetic oligonucleotide
  Target: FXN; (+) strand; PAM type: YTN; PAM sequence: TTT
aagaaacttttaaataaatg

SEQ ID NO: 34921 - DNA, 20 bp, Artificial Sequence
  Description of Artificial Sequence: Synthetic oligonucleotide
  Target: FXN; (+) strand; PAM type: YTN; PAM sequence: TTA
agaaacttttaaataaatga

SEQ ID NO: 34922 - DNA, 20 bp, Artificial Sequence
  Description of Artificial Sequence: Synthetic oligonucleotide
  Target: FXN; (+) strand; PAM type: YTN; PAM sequence: CTT
ttaaataaatgaaatatagt

SEQ ID NO: 34923 - DNA, 20 bp, Artificial Sequence
  Description of Artificial Sequence: Synthetic oligonucleotide
  Target: FXN; (+) strand; PAM type: YTN; PAM sequence: TTT
taaataaatgaaatatagtc

SEQ ID NO: 34924 - DNA, 20 bp, Artificial Sequence
  Description of Artificial Sequence: Synthetic oligonucleotide
  Target: FXN; (+) strand; PAM type: YTN; PAM sequence: TTT
aaataaatgaaatatagtca

SEQ ID NO: 34925 - DNA, 20 bp, Artificial Sequence
  Description of Artificial Sequence: Synthetic oligonucleotide
  Target: FXN; (+) strand; PAM type: YTN; PAM sequence: TTA
aataaatgaaatatagtcat

SEQ ID NO: 34926 - DNA, 20 bp, Artificial Sequence
  Description of Artificial Sequence: Synthetic oligonucleotide
  Target: FXN; (+) strand; PAM type: YTN; PAM sequence: TTT
caggaaaaaaaatgtttttt

SEQ ID NO: 34927 - DNA, 20 bp, Artificial Sequence
  Description of Artificial Sequence: Synthetic oligonucleotide
  Target: FXN; (+) strand; PAM type: YTN; PAM sequence: TTC
aggaaaaaaaatgttttttt

SEQ ID NO: 34928 - DNA, 20 bp, Artificial Sequence
  Description of Artificial Sequence: Synthetic oligonucleotide
  Target: FXN; (+) strand; PAM type: YTN; PAM sequence: TTT
ttttaaacaaacttacgtat

SEQ ID NO: 34929 - DNA, 20 bp, Artificial Sequence
  Description of Artificial Sequence: Synthetic oligonucleotide
  Target: FXN; (+) strand; PAM type: YTN; PAM sequence: TTT
tttaaacaaacttacgtatt

SEQ ID NO: 34930 - DNA, 20 bp, Artificial Sequence
  Description of Artificial Sequence: Synthetic oligonucleotide
  Target: FXN; (+) strand; PAM type: YTN; PAM sequence: TTT
ttaaacaaacttacgtattg

SEQ ID NO: 34931 - DNA, 20 bp, Artificial Sequence
  Description of Artificial Sequence: Synthetic oligonucleotide
  Target: FXN; (+) strand; PAM type: YTN; PAM sequence: TTT
taaacaaacttacgtattgt

SEQ ID NO: 34932 - DNA, 20 bp, Artificial Sequence
  Description of Artificial Sequence: Synthetic oligonucleotide
  Target: FXN; (+) strand; PAM type: YTN; PAM sequence: TTT
aaacaaacttacgtattgta

SEQ ID NO: 34933 - DNA, 20 bp, Artificial Sequence
  Description of Artificial Sequence: Synthetic oligonucleotide
  Target: FXN; (+) strand; PAM type: YTN; PAM sequence: TTA
aacaaacttacgtattgtat

SEQ ID NO: 34934 - DNA, 20 bp, Artificial Sequence
  Description of Artificial Sequence: Synthetic oligonucleotide
  Target: FXN; (+) strand; PAM type: YTN; PAM sequence: CTT
acgtattgtataatcccagc

SEQ ID NO: 34935 - DNA, 20 bp, Artificial Sequence
  Description of Artificial Sequence: Synthetic oligonucleotide
  Target: FXN; (+) strand; PAM type: YTN; PAM sequence: TTA
cgtattgtataatcccagcc

SEQ ID NO: 34936 - DNA, 20 bp, Artificial Sequence
  Description of Artificial Sequence: Synthetic oligonucleotide
  Target: FXN; (+) strand; PAM type: YTN; PAM sequence: TTG
tataatcccagcccttttaa

SEQ ID NO: 34937 - DNA, 20 bp, Artificial Sequence
  Description of Artificial Sequence: Synthetic oligonucleotide
  Target: FXN; (+) strand; PAM type: YTN; PAM sequence: CTT
ttaaaaaatgctttcaaaaa

SEQ ID NO: 34938 - DNA, 20 bp, Artificial Sequence
  Description of Artificial Sequence: Synthetic oligonucleotide
  Target: FXN; (+) strand; PAM type: YTN; PAM sequence: TTT
taaaaaatgctttcaaaaac

SEQ ID NO: 34939 - DNA, 20 bp, Artificial Sequence
  Description of Artificial Sequence: Synthetic oligonucleotide
  Target: FXN; (+) strand; PAM type: YTN; PAM sequence: TTT
aaaaaatgctttcaaaaact

SEQ ID NO: 34940 - DNA, 20 bp, Artificial Sequence
  Description of Artificial Sequence: Synthetic oligonucleotide
  Target: FXN; (+) strand; PAM type: YTN; PAM sequence: TTA
aaaaatgctttcaaaaactg

SEQ ID NO: 34941 - DNA, 20 bp, Artificial Sequence
  Description of Artificial Sequence: Synthetic oligonucleotide
  Target: FXN; (+) strand; PAM type: YTN; PAM sequence: CTT
tcaaaaactggcagtcaact

SEQ ID NO: 34942 - DNA, 20 bp, Artificial Sequence
  Description of Artificial Sequence: Synthetic oligonucleotide
  Target: FXN; (+) strand; PAM type: YTN; PAM sequence: TTT
caaaaactggcagtcaactc

SEQ ID NO: 34943 - DNA, 20 bp, Artificial Sequence
  Description of Artificial Sequence: Synthetic oligonucleotide
  Target: FXN; (+) strand; PAM type: YTN; PAM sequence: TTC
aaaaactggcagtcaactca

SEQ ID NO: 34944 - DNA, 20 bp, Artificial Sequence
  Description of Artificial Sequence: Synthetic oligonucleotide
  Target: FXN; (+) strand; PAM type: YTN; PAM sequence: CTG
gcagtcaactcataaaagga

SEQ ID NO: 34945 - DNA, 20 bp, Artificial Sequence
  Description of Artificial Sequence: Synthetic oligonucleotide
  Target: FXN; (+) strand; PAM type: YTN; PAM sequence: CTC
ataaaaggacaaatacttat

SEQ ID NO: 34946 - DNA, 20 bp, Artificial Sequence
  Description of Artificial Sequence: Synthetic oligonucleotide
  Target: FXN; (+) strand; PAM type: YTN; PAM sequence: CTT
atgattccactgatgaagta

SEQ ID NO: 34947 - DNA, 20 bp, Artificial Sequence
  Description of Artificial Sequence: Synthetic oligonucleotide
  Target: FXN; (+) strand; PAM type: YTN; PAM sequence: TTA
tgattccactgatgaagtag

SEQ ID NO: 34948 - DNA, 20 bp, Artificial Sequence
  Description of Artificial Sequence: Synthetic oligonucleotide
  Target: FXN; (+) strand; PAM type: YTN; PAM sequence: TTC
cactgatgaagtagtcaaaa

SEQ ID NO: 34949 - DNA, 20 bp, Artificial Sequence
  Description of Artificial Sequence: Synthetic oligonucleotide
  Target: FXN; (+) strand; PAM type: YTN; PAM sequence: CTG
atgaagtagtcaaaagtagt

SEQ ID NO: 34950 - DNA, 20 bp, Artificial Sequence
  Description of Artificial Sequence: Synthetic oligonucleotide
  Target: FXN; (+) strand; PAM type: YTN; PAM sequence: TTT
ttattttcaattaaaaaaac

SEQ ID NO: 34951 - DNA, 20 bp, Artificial Sequence
  Description of Artificial Sequence: Synthetic oligonucleotide
  Target: FXN; (+) strand; PAM type: YTN; PAM sequence: TTT
tattttcaattaaaaaaaca

SEQ ID NO: 34952 - DNA, 20 bp, Artificial Sequence
  Description of Artificial Sequence: Synthetic oligonucleotide
  Target: FXN; (+) strand; PAM type: YTN; PAM sequence: TTT
attttcaattaaaaaaacat

SEQ ID NO: 34953 - DNA, 20 bp, Artificial Sequence
  Description of Artificial Sequence: Synthetic oligonucleotide
  Target: FXN; (+) strand; PAM type: YTN; PAM sequence: TTA
ttttcaattaaaaaaacatc

SEQ ID NO: 34954 - DNA, 20 bp, Artificial Sequence
  Description of Artificial Sequence: Synthetic oligonucleotide
  Target: FXN; (+) strand; PAM type: YTN; PAM sequence: TTT
tcaattaaaaaaacatcttt

SEQ ID NO: 34955 - DNA, 20 bp, Artificial Sequence
  Description of Artificial Sequence: Synthetic oligonucleotide
  Target: FXN; (+) strand; PAM type: YTN; PAM sequence: TTT
caattaaaaaaacatctttt

SEQ ID NO: 34956 - DNA, 20 bp, Artificial Sequence
  Description of Artificial Sequence: Synthetic oligonucleotide
  Target: FXN; (+) strand; PAM type: YTN; PAM sequence: TTC
aattaaaaaaacatcttttt

SEQ ID NO: 34957 - DNA, 20 bp, Artificial Sequence
  Description of Artificial Sequence: Synthetic oligonucleotide
  Target: FXN; (+) strand; PAM type: YTN; PAM sequence: TTA
aaaaaacatcttttttttag

SEQ ID NO: 34958 - DNA, 20 bp, Artificial Sequence
  Description of Artificial Sequence: Synthetic oligonucleotide
  Target: FXN; (+) strand; PAM type: YTN; PAM sequence: CTT
ttttttagtcaaaatcatag

SEQ ID NO: 34959 - DNA, 20 bp, Artificial Sequence
  Description of Artificial Sequence: Synthetic oligonucleotide
  Target: FXN; (+) strand; PAM type: YTN; PAM sequence: TTT
tttttagtcaaaatcataga

SEQ ID NO: 34960 - DNA, 20 bp, Artificial Sequence
  Description of Artificial Sequence: Synthetic oligonucleotide
  Target: FXN; (+) strand; PAM type: YTN; PAM sequence: TTT
ttttagtcaaaatcatagaa

SEQ ID NO: 34961 - DNA, 20 bp, Artificial Sequence
  Description of Artificial Sequence: Synthetic oligonucleotide
  Target: FXN; (+) strand; PAM type: YTN; PAM sequence: TTT
tttagtcaaaatcatagaaa

SEQ ID NO: 34962 - DNA, 20 bp, Artificial Sequence
  Description of Artificial Sequence: Synthetic oligonucleotide
  Target: FXN; (+) strand; PAM type: YTN; PAM sequence: TTT
ttagtcaaaatcatagaaat

SEQ ID NO: 34963 - DNA, 20 bp, Artificial Sequence
  Description of Artificial Sequence: Synthetic oligonucleotide
  Target: FXN; (+) strand; PAM type: YTN; PAM sequence: TTT
tagtcaaaatcatagaaata

SEQ ID NO: 34964 - DNA, 20 bp, Artificial Sequence
  Description of Artificial Sequence: Synthetic oligonucleotide
  Target: FXN; (+) strand; PAM type: YTN; PAM sequence: TTT
agtcaaaatcatagaaatag

SEQ ID NO: 34965 - DNA, 20 bp, Artificial Sequence
  Description of Artificial Sequence: Synthetic oligonucleotide
  Target: FXN; (+) strand; PAM type: YTN; PAM sequence: TTA
gtcaaaatcatagaaataga

SEQ ID NO: 34966 - DNA, 20 bp, Artificial Sequence
  Description of Artificial Sequence: Synthetic oligonucleotide
  Target: FXN; (+) strand; PAM type: YTN; PAM sequence: TTA
ctaagggctatgggatgggg

SEQ ID NO: 34967 - DNA, 20 bp, Artificial Sequence
  Description of Artificial Sequence: Synthetic oligonucleotide
  Target: FXN; (+) strand; PAM type: YTN; PAM sequence: CTA
agggctatgggatggggaaa

SEQ ID NO: 34968 - DNA, 20 bp, Artificial Sequence
  Description of Artificial Sequence: Synthetic oligonucleotide
  Target: FXN; (+) strand; PAM type: YTN; PAM sequence: CTA
tgggatggggaaattagtgt

SEQ ID NO: 34969 - DNA, 20 bp, Artificial Sequence
  Description of Artificial Sequence: Synthetic oligonucleotide
  Target: FXN; (+) strand; PAM type: YTN; PAM sequence: TTA
gtgtctaatgggcatagagt

SEQ ID NO: 34970 - DNA, 20 bp, Artificial Sequence
  Description of Artificial Sequence: Synthetic oligonucleotide
  Target: FXN; (+) strand; PAM type: YTN; PAM sequence: CTA
atgggcatagagtttcagtg

SEQ ID NO: 34971 - DNA, 20 bp, Artificial Sequence
  Description of Artificial Sequence: Synthetic oligonucleotide
  Target: FXN; (+) strand; PAM type: YTN; PAM sequence: TTT
cagtgttacaaggtgaaaag

SEQ ID NO: 34972 - DNA, 20 bp, Artificial Sequence
  Description of Artificial Sequence: Synthetic oligonucleotide
  Target: FXN; (+) strand; PAM type: YTN; PAM sequence: TTC
agtgttacaaggtgaaaagt

SEQ ID NO: 34973 - DNA, 20 bp, Artificial Sequence
  Description of Artificial Sequence: Synthetic oligonucleotide
  Target: FXN; (+) strand; PAM type: YTN; PAM sequence: TTA
caaggtgaaaagttctagag

SEQ ID NO: 34974 - DNA, 20 bp, Artificial Sequence
  Description of Artificial Sequence: Synthetic oligonucleotide
  Target: FXN; (+) strand; PAM type: YTN; PAM sequence: TTC
tagagttatgctgcccagca

SEQ ID NO: 34975 - DNA, 20 bp, Artificial Sequence
  Description of Artificial Sequence: Synthetic oligonucleotide
  Target: FXN; (+) strand; PAM type: YTN; PAM sequence: CTA
gagttatgctgcccagcagt

SEQ ID NO: 34976 - DNA, 20 bp, Artificial Sequence
  Description of Artificial Sequence: Synthetic oligonucleotide
  Target: FXN; (+) strand; PAM type: YTN; PAM sequence: TTA
tgctgcccagcagtgtgaat

SEQ ID NO: 34977 - DNA, 20 bp, Artificial Sequence
  Description of Artificial Sequence: Synthetic oligonucleotide
  Target: FXN; (+) strand; PAM type: YTN; PAM sequence: CTG
cccagcagtgtgaatatact

SEQ ID NO: 34978 - DNA, 20 bp, Artificial Sequence
  Description of Artificial Sequence: Synthetic oligonucleotide
  Target: FXN; (+) strand; PAM type: YTN; PAM sequence: CTT
tattgttctgtacacttaac

SEQ ID NO: 34979 - DNA, 20 bp, Artificial Sequence
  Description of Artificial Sequence: Synthetic oligonucleotide
  Target: FXN; (+) strand; PAM type: YTN; PAM sequence: TTT
attgttctgtacacttaaca

SEQ ID NO: 34980 - DNA, 20 bp, Artificial Sequence
  Description of Artificial Sequence: Synthetic oligonucleotide
  Target: FXN; (+) strand; PAM type: YTN; PAM sequence: TTA
ttgttctgtacacttaacat

SEQ ID NO: 34981 - DNA, 20 bp, Artificial Sequence
  Description of Artificial Sequence: Synthetic oligonucleotide
  Target: FXN; (+) strand; PAM type: YTN; PAM sequence: TTG
ttctgtacacttaacatggt

SEQ ID NO: 34982 - DNA, 20 bp, Artificial Sequence
  Description of Artificial Sequence: Synthetic oligonucleotide
  Target: FXN; (+) strand; PAM type: YTN; PAM sequence: TTC
tgtacacttaacatggttaa

SEQ ID NO: 34983 - DNA, 20 bp, Artificial Sequence
  Description of Artificial Sequence: Synthetic oligonucleotide
  Target: FXN; (+) strand; PAM type: YTN; PAM sequence: CTG
tacacttaacatggttaata

SEQ ID NO: 34984 - DNA, 20 bp, Artificial Sequence
  Description of Artificial Sequence: Synthetic oligonucleotide
  Target: FXN; (+) strand; PAM type: YTN; PAM sequence: CTT
aacatggttaatatggtaaa

SEQ ID NO: 34985 - DNA, 20 bp, Artificial Sequence
  Description of Artificial Sequence: Synthetic oligonucleotide
  Target: FXN; (+) strand; PAM type: YTN; PAM sequence: TTA
acatggttaatatggtaaat

SEQ ID NO: 34986 - DNA, 20 bp, Artificial Sequence
  Description of Artificial Sequence: Synthetic oligonucleotide
  Target: FXN; (+) strand; PAM type: YTN; PAM sequence: TTA
atatggtaaatttagcgtta

SEQ ID NO: 34987 - DNA, 20 bp, Artificial Sequence
  Description of Artificial Sequence: Synthetic oligonucleotide
  Target: FXN; (+) strand; PAM type: YTN; PAM sequence: TTT
agcgttatgtgctttttact

SEQ ID NO: 34988 - DNA, 20 bp, Artificial Sequence
  Description of Artificial Sequence: Synthetic oligonucleotide
  Target: FXN; (+) strand; PAM type: YTN; PAM sequence: TTA
gcgttatgtgctttttacta

SEQ ID NO: 34989 - DNA, 20 bp, Artificial Sequence
  Description of Artificial Sequence: Synthetic oligonucleotide
  Target: FXN; (+) strand; PAM type: YTN; PAM sequence: TTA
tgtgctttttactatagtaa

SEQ ID NO: 34990 - DNA, 20 bp, Artificial Sequence
  Description of Artificial Sequence: Synthetic oligonucleotide
  Target: FXN; (+) strand; PAM type: YTN; PAM sequence: CTT
tttactatagtaaaattaaa

SEQ ID NO: 34991 - DNA, 20 bp, Artificial Sequence
  Description of Artificial Sequence: Synthetic oligonucleotide
  Target: FXN; (+) strand; PAM type: YTN; PAM sequence: TTT
ttactatagtaaaattaaaa

SEQ ID NO: 34992 - DNA, 20 bp, Artificial Sequence
  Description of Artificial Sequence: Synthetic oligonucleotide
  Target: FXN; (+) strand; PAM type: YTN; PAM sequence: TTT
tactatagtaaaattaaaaa

SEQ ID NO: 34993 - DNA, 20 bp, Artificial Sequence
  Description of Artificial Sequence: Synthetic oligonucleotide
  Target: FXN; (+) strand; PAM type: YTN; PAM sequence: TTT
actatagtaaaattaaaaaa

SEQ ID NO: 34994 - DNA, 20 bp, Artificial Sequence
  Description of Artificial Sequence: Synthetic oligonucleotide
  Target: FXN; (+) strand; PAM type: YTN; PAM sequence: TTA
ctatagtaaaattaaaaaaa

SEQ ID NO: 34995 - DNA, 20 bp, Artificial Sequence
  Description of Artificial Sequence: Synthetic oligonucleotide
  Target: FXN; (+) strand; PAM type: YTN; PAM sequence: CTA
tagtaaaattaaaaaaaaaa

SEQ ID NO: 34996 - DNA, 20 bp, Artificial Sequence
  Description of Artificial Sequence: Synthetic oligonucleotide
  Target: FXN; (+) strand; PAM type: YTN; PAM sequence: TTA
aaaaaaaaaaaaatggggcc

SEQ ID NO: 34997 - DNA, 20 bp, Artificial Sequence
  Description of Artificial Sequence: Synthetic oligonucleotide
  Target: FXN; (+) strand; PAM type: YTN; PAM sequence: CTC
acacctgtaacataatccca

SEQ ID NO: 34998 - DNA, 20 bp, Artificial Sequence
  Description of Artificial Sequence: Synthetic oligonucleotide
  Target: FXN; (+) strand; PAM type: YTN; PAM sequence: CTG
taacataatcccagcacttt

SEQ ID NO: 34999 - DNA, 20 bp, Artificial Sequence
  Description of Artificial Sequence: Synthetic oligonucleotide
  Target: FXN; (+) strand; PAM type: YTN; PAM sequence: CTT
tgggaggccgaggtaggagg

SEQ ID NO: 35000 - DNA, 20 bp, Artificial Sequence
  Description of Artificial Sequence: Synthetic oligonucleotide
  Target: FXN; (+) strand; PAM type: YTN; PAM sequence: TTT
gggaggccgaggtaggagga

SEQ ID NO: 35001 - DNA, 20 bp, Artificial Sequence
  Description of Artificial Sequence: Synthetic oligonucleotide
  Target: FXN; (+) strand; PAM type: YTN; PAM sequence: TTG
ggaggccgaggtaggaggat

SEQ ID NO: 35002 - DNA, 20 bp, Artificial Sequence
  Description of Artificial Sequence: Synthetic oligonucleotide
  Target: FXN; (+) strand; PAM type: YTN; PAM sequence: CTT
gaggccagaagtttgaaacc

SEQ ID NO: 35003 - DNA, 20 bp, Artificial Sequence
  Description of Artificial Sequence: Synthetic oligonucleotide
  Target: FXN; (+) strand; PAM type: YTN; PAM sequence: TTG
aggccagaagtttgaaacca

SEQ ID NO: 35004 - DNA, 20 bp, Artificial Sequence
  Description of Artificial Sequence: Synthetic oligonucleotide
  Target: FXN; (+) strand; PAM type: YTN; PAM sequence: TTT
gaaaccagcctggtcaatat

SEQ ID NO: 35005 - DNA, 20 bp, Artificial Sequence
  Description of Artificial Sequence: Synthetic oligonucleotide
  Target: FXN; (+) strand; PAM type: YTN; PAM sequence: TTG
aaaccagcctggtcaatata

SEQ ID NO: 35006 - DNA, 20 bp, Artificial Sequence
  Description of Artificial Sequence: Synthetic oligonucleotide
  Target: FXN; (+) strand; PAM type: YTN; PAM sequence: CTG
gtcaatatagcgagacctca

SEQ ID NO: 35007 - DNA, 20 bp, Artificial Sequence
  Description of Artificial Sequence: Synthetic oligonucleotide
  Target: FXN; (+) strand; PAM type: YTN; PAM sequence: CTC
atctctacaaaagaaaaatg

SEQ ID NO: 35008 - DNA, 20 bp, Artificial Sequence
  Description of Artificial Sequence: Synthetic oligonucleotide
  Target: FXN; (+) strand; PAM type: YTN; PAM sequence: CTC
tacaaaagaaaaatgttaaa

SEQ ID NO: 35009 - DNA, 20 bp, Artificial Sequence
  Description of Artificial Sequence: Synthetic oligonucleotide
  Target: FXN; (+) strand; PAM type: YTN; PAM sequence: CTA
caaaagaaaaatgttaaaat

SEQ ID NO: 35010 - DNA, 20 bp, Artificial Sequence
  Description of Artificial Sequence: Synthetic oligonucleotide
  Target: FXN; (+) strand; PAM type: YTN; PAM sequence: TTA
aaattagacaggtgtggtgt

SEQ ID NO: 35011 - DNA, 20 bp, Artificial Sequence
  Description of Artificial Sequence: Synthetic oligonucleotide
  Target: FXN; (+) strand; PAM type: YTN; PAM sequence: TTA
gacaggtgtggtgtctgtag

SEQ ID NO: 35012 - DNA, 20 bp, Artificial Sequence
  Description of Artificial Sequence: Synthetic oligonucleotide
  Target: FXN; (+) strand; PAM type: YTN; PAM sequence: CTG
tagtcccagctctctggagg

SEQ ID NO: 35013 - DNA, 20 bp, Artificial Sequence
  Description of Artificial Sequence: Synthetic oligonucleotide
  Target: FXN; (+) strand; PAM type: YTN; PAM sequence: CTC
tctggaggcagggactgagt

SEQ ID NO: 35014 - DNA, 20 bp, Artificial Sequence
  Description of Artificial Sequence: Synthetic oligonucleotide
  Target: FXN; (+) strand; PAM type: YTN; PAM sequence: CTC
tggaggcagggactgagtca

SEQ ID NO: 35015 - DNA, 20 bp, Artificial Sequence
  Description of Artificial Sequence: Synthetic oligonucleotide
  Target: FXN; (+) strand; PAM type: YTN; PAM sequence: CTG
gaggcagggactgagtcaga

SEQ ID NO: 35016 - DNA, 20 bp, Artificial Sequence
  Description of Artificial Sequence: Synthetic oligonucleotide
  Target: FXN; (+) strand; PAM type: YTN; PAM sequence: CTG
agtcagaggatcacttgagc

SEQ ID NO: 35017 - DNA, 20 bp, Artificial Sequence
  Description of Artificial Sequence: Synthetic oligonucleotide
  Target: FXN; (+) strand; PAM type: YTN; PAM sequence: CTT
gagcataggggtttgaggct

SEQ ID NO: 35018 - DNA, 20 bp, Artificial Sequence
  Description of Artificial Sequence: Synthetic oligonucleotide
  Target: FXN; (+) strand; PAM type: YTN; PAM sequence: TTG
agcataggggtttgaggctg

SEQ ID NO: 35019 - DNA, 20 bp, Artificial Sequence
  Description of Artificial Sequence: Synthetic oligonucleotide
  Target: FXN; (+) strand; PAM type: YTN; PAM sequence: TTT
gaggctgcagtgagccatga

SEQ ID NO: 35020 - DNA, 20 bp, Artificial Sequence
  Description of Artificial Sequence: Synthetic oligonucleotide
  Target: FXN; (+) strand; PAM type: YTN; PAM sequence: TTG
aggctgcagtgagccatgat

SEQ ID NO: 35021 - DNA, 20 bp, Artificial Sequence
  Description of Artificial Sequence: Synthetic oligonucleotide
  Target: FXN; (+) strand; PAM type: YTN; PAM sequence: CTG
cagtgagccatgatcctgcc

SEQ ID NO: 35022 - DNA, 20 bp, Artificial Sequence
  Description of Artificial Sequence: Synthetic oligonucleotide
  Target: FXN; (+) strand; PAM type: YTN; PAM sequence: CTG
ccactgctgcagcctgagca

SEQ ID NO: 35023 - DNA, 20 bp, Artificial Sequence
  Description of Artificial Sequence: Synthetic oligonucleotide
  Target: FXN; (+) strand; PAM type: YTN; PAM sequence: CTG
ctgcagcctgagcaacagag

SEQ ID NO: 35024 - DNA, 20 bp, Artificial Sequence
  Description of Artificial Sequence: Synthetic oligonucleotide
  Target: FXN; (+) strand; PAM type: YTN; PAM sequence: CTG
cagcctgagcaacagagcaa

SEQ ID NO: 35025 - DNA, 20 bp, Artificial Sequence
  Description of Artificial Sequence: Synthetic oligonucleotide
  Target: FXN; (+) strand; PAM type: YTN; PAM sequence: CTG
agcaacagagcaagaccctg

SEQ ID NO: 35026 - DNA, 20 bp, Artificial Sequence
  Description of Artificial Sequence: Synthetic oligonucleotide
  Target: FXN; (+) strand; PAM type: YTN; PAM sequence: CTG
ttgtaaaaacaaacaaacaa

SEQ ID NO: 35027 - DNA, 20 bp, Artificial Sequence
  Description of Artificial Sequence: Synthetic oligonucleotide
  Target: FXN; (+) strand; PAM type: YTN; PAM sequence: TTG
taaaaacaaacaaacaaaaa

SEQ ID NO: 35028 - DNA, 20 bp, Artificial Sequence
  Description of Artificial Sequence: Synthetic oligonucleotide
  Target: FXN; (+) strand; PAM type: YTN; PAM sequence: CTG
gcagctgatacctgagagtg

SEQ ID NO: 35029 - DNA, 20 bp, Artificial Sequence
  Description of Artificial Sequence: Synthetic oligonucleotide
  Target: FXN; (+) strand; PAM type: YTN; PAM sequence: CTG
atacctgagagtgaatatct

SEQ ID NO: 35030 - DNA, 20 bp, Artificial Sequence
  Description of Artificial Sequence: Synthetic oligonucleotide
  Target: FXN; (+) strand; PAM type: YTN; PAM sequence: CTG
agagtgaatatcttttatcg

SEQ ID NO: 35031 - DNA, 20 bp, Artificial Sequence
  Description of Artificial Sequence: Synthetic oligonucleotide
  Target: FXN; (+) strand; PAM type: YTN; PAM sequence: CTT
ttatcgctggttaatgggat

SEQ ID NO: 35032 - DNA, 20 bp, Artificial Sequence
  Description of Artificial Sequence: Synthetic oligonucleotide
  Target: FXN; (+) strand; PAM type: YTN; PAM sequence: TTT
tatcgctggttaatgggatt

SEQ ID NO: 35033 - DNA, 20 bp, Artificial Sequence
  Description of Artificial Sequence: Synthetic oligonucleotide
  Target: FXN; (+) strand; PAM type: YTN; PAM sequence: TTT
atcgctggttaatgggattg

SEQ ID NO: 35034 - DNA, 20 bp, Artificial Sequence
  Description of Artificial Sequence: Synthetic oligonucleotide
  Target: FXN; (+) strand; PAM type: YTN; PAM sequence: TTA
tcgctggttaatgggattga

SEQ ID NO: 35035 - DNA, 20 bp, Artificial Sequence
  Description of Artificial Sequence: Synthetic oligonucleotide
  Target: FXN; (+) strand; PAM type: YTN; PAM sequence: CTG
gttaatgggattgagagaat

SEQ ID NO: 35036 - DNA, 20 bp, Artificial Sequence
  Description of Artificial Sequence: Synthetic oligonucleotide
  Target: FXN; (+) strand; PAM type: YTN; PAM sequence: TTA
atgggattgagagaatgctt

SEQ ID NO: 35037 - DNA, 20 bp, Artificial Sequence
  Description of Artificial Sequence: Synthetic oligonucleotide
  Target: FXN; (+) strand; PAM type: YTN; PAM sequence: TTG
agagaatgcttcatcttata

SEQ ID NO: 35038 - DNA, 20 bp, Artificial Sequence
  Description of Artificial Sequence: Synthetic oligonucleotide
  Target: FXN; (+) strand; PAM type: YTN; PAM sequence: CTT
catcttatagaaagaacagt

SEQ ID NO: 35039 - DNA, 20 bp, Artificial Sequence
  Description of Artificial Sequence: Synthetic oligonucleotide
  Target: FXN; (+) strand; PAM type: YTN; PAM sequence: TTC
atcttatagaaagaacagtg

SEQ ID NO: 35040 - DNA, 20 bp, Artificial Sequence
  Description of Artificial Sequence: Synthetic oligonucleotide
  Target: FXN; (+) strand; PAM type: YTN; PAM sequence: CTT
atagaaagaacagtgtcttt

SEQ ID NO: 35041 - DNA, 20 bp, Artificial Sequence
  Description of Artificial Sequence: Synthetic oligonucleotide
  Target: FXN; (+) strand; PAM type: YTN; PAM sequence: TTA
tagaaagaacagtgtctttg

SEQ ID NO: 35042 - DNA, 20 bp, Artificial Sequence
  Description of Artificial Sequence: Synthetic oligonucleotide
  Target: FXN; (+) strand; PAM type: YTN; PAM sequence: CTT
tggacccacagagacctgga

SEQ ID NO: 35043 - DNA, 20 bp, Artificial Sequence
  Description of Artificial Sequence: Synthetic oligonucleotide
  Target: FXN; (+) strand; PAM type: YTN; PAM sequence: TTT
ggacccacagagacctggat

SEQ ID NO: 35044 - DNA, 20 bp, Artificial Sequence
  Description of Artificial Sequence: Synthetic oligonucleotide
  Target: FXN; (+) strand; PAM type: YTN; PAM sequence: TTG
gacccacagagacctggatt

SEQ ID NO: 35045 - DNA, 20 bp, Artificial Sequence
  Description of Artificial Sequence: Synthetic oligonucleotide
  Target: FXN; (+) strand; PAM type: YTN; PAM sequence: CTG
gatttaagattagctctgcc

SEQ ID NO: 35046 - DNA, 20 bp, Artificial Sequence
  Description of Artificial Sequence: Synthetic oligonucleotide
  Target: FXN; (+) strand; PAM type: YTN; PAM sequence: TTT
aagattagctctgccaatta

SEQ ID NO: 35047 - DNA, 20 bp, Artificial Sequence
  Description of Artificial Sequence: Synthetic oligonucleotide
  Target: FXN; (+) strand; PAM type: YTN; PAM sequence: TTA
agattagctctgccaattac

SEQ ID NO: 35048 - DNA, 20 bp, Artificial Sequence
  Description of Artificial Sequence: Synthetic oligonucleotide
  Target: FXN; (+) strand; PAM type: YTN; PAM sequence: TTA
gctctgccaattactgagta

SEQ ID NO: 35049 - DNA, 20 bp, Artificial Sequence
  Description of Artificial Sequence: Synthetic oligonucleotide
  Target: FXN; (+) strand; PAM type: YTN; PAM sequence: CTC
tgccaattactgagtactct

SEQ ID NO: 35050 - DNA, 20 bp, Artificial Sequence
  Description of Artificial Sequence: Synthetic oligonucleotide
  Target: FXN; (+) strand; PAM type: YTN; PAM sequence: CTG
ccaattactgagtactcttt

SEQ ID NO: 35051 - DNA, 20 bp, Artificial Sequence
  Description of Artificial Sequence: Synthetic oligonucleotide
  Target: FXN; (+) strand; PAM type: YTN; PAM sequence: TTA
ctgagtactctttactatga

SEQ ID NO: 35052 - DNA, 20 bp, Artificial Sequence
  Description of Artificial Sequence: Synthetic oligonucleotide
  Target: FXN; (+) strand; PAM type: YTN; PAM sequence: CTG
agtactctttactatgaacc

SEQ ID NO: 35053 - DNA, 20 bp, Artificial Sequence
  Description of Artificial Sequence: Synthetic oligonucleotide
  Target: FXN; (+) strand; PAM type: YTN; PAM sequence: CTC
tttactatgaacctctgttt

SEQ ID NO: 35054 - DNA, 20 bp, Artificial Sequence
  Description of Artificial Sequence: Synthetic oligonucleotide
  Target: FXN; (+) strand; PAM type: YTN; PAM sequence: CTT
tactatgaacctctgttttc

SEQ ID NO: 35055 - DNA, 20 bp, Artificial Sequence
  Description of Artificial Sequence: Synthetic oligonucleotide
  Target: FXN; (+) strand; PAM type: YTN; PAM sequence: TTT
actatgaacctctgttttcc

SEQ ID NO: 35056 - DNA, 20 bp, Artificial Sequence
  Description of Artificial Sequence: Synthetic oligonucleotide
  Target: FXN; (+) strand; PAM type: YTN; PAM sequence: TTA
ctatgaacctctgttttcct

SEQ ID NO: 35057 - DNA, 20 bp, Artificial Sequence
  Description of Artificial Sequence: Synthetic oligonucleotide
  Target: FXN; (+) strand; PAM type: YTN; PAM sequence: CTA
tgaacctctgttttcctcat

SEQ ID NO: 35058 - DNA, 20 bp, Artificial Sequence
  Description of Artificial Sequence: Synthetic oligonucleotide
  Target: FXN; (+) strand; PAM type: YTN; PAM sequence: CTC
tgttttcctcatctgtgaaa

SEQ ID NO: 35059 - DNA, 20 bp, Artificial Sequence
  Description of Artificial Sequence: Synthetic oligonucleotide
  Target: FXN; (+) strand; PAM type: YTN; PAM sequence: CTG
ttttcctcatctgtgaaact

SEQ ID NO: 35060 - DNA, 20 bp, Artificial Sequence
  Description of Artificial Sequence: Synthetic oligonucleotide
  Target: FXN; (+) strand; PAM type: YTN; PAM sequence: TTT
tcctcatctgtgaaactgga

SEQ ID NO: 35061 - DNA, 20 bp, Artificial Sequence
  Description of Artificial Sequence: Synthetic oligonucleotide
  Target: FXN; (+) strand; PAM type: YTN; PAM sequence: TTT
cctcatctgtgaaactggaa

SEQ ID NO: 35062 - DNA, 20 bp, Artificial Sequence
  Description of Artificial Sequence: Synthetic oligonucleotide
  Target: FXN; (+) strand; PAM type: YTN; PAM sequence: TTC
ctcatctgtgaaactggaat

SEQ ID NO: 35063 - DNA, 20 bp, Artificial Sequence
  Description of Artificial Sequence: Synthetic oligonucleotide
  Target: FXN; (+) strand; PAM type: YTN; PAM sequence: CTC
atctgtgaaactggaataat

SEQ ID NO: 35064 - DNA, 20 bp, Artificial Sequence
  Description of Artificial Sequence: Synthetic oligonucleotide
  Target: FXN; (+) strand; PAM type: YTN; PAM sequence: CTG
tgaaactggaataatgaatc

SEQ ID NO: 35065 - DNA, 20 bp, Artificial Sequence
  Description of Artificial Sequence: Synthetic oligonucleotide
  Target: FXN; (+) strand; PAM type: YTN; PAM sequence: CTG
gaataatgaatcctaccgcc

SEQ ID NO: 35066 - DNA, 20 bp, Artificial Sequence
  Description of Artificial Sequence: Synthetic oligonucleotide
  Target: FXN; (+) strand; PAM type: YTN; PAM sequence: CTA
ccgccaacaattgtagtcaa

SEQ ID NO: 35067 - DNA, 20 bp, Artificial Sequence
  Description of Artificial Sequence: Synthetic oligonucleotide
  Target: FXN; (+) strand; PAM type: YTN; PAM sequence: TTG
tagtcaagttggaaacaatt

SEQ ID NO: 35068 - DNA, 20 bp, Artificial Sequence
  Description of Artificial Sequence: Synthetic oligonucleotide
  Target: FXN; (+) strand; PAM type: YTN; PAM sequence: TTG
gaaacaatttacacaaagtg

SEQ ID NO: 35069 - DNA, 20 bp, Artificial Sequence
  Description of Artificial Sequence: Synthetic oligonucleotide
  Target: FXN; (+) strand; PAM type: YTN; PAM sequence: TTT
acacaaagtgccaaacacca

SEQ ID NO: 35070 - DNA, 20 bp, Artificial Sequence
  Description of Artificial Sequence: Synthetic oligonucleotide
  Target: FXN; (+) strand; PAM type: YTN; PAM sequence: TTA
cacaaagtgccaaacaccaa

SEQ ID NO: 35071 - DNA, 20 bp, Artificial Sequence
  Description of Artificial Sequence: Synthetic oligonucleotide
  Target: FXN; (+) strand; PAM type: YTN; PAM sequence: CTG
gcacagtaggaaccgagtaa

SEQ ID NO: 35072 - DNA, 20 bp, Artificial Sequence
  Description of Artificial Sequence: Synthetic oligonucleotide
  Target: FXN; (+) strand; PAM type: YTN; PAM sequence: TTA
atatttttatcagtgtctgc

SEQ ID NO: 35073 - DNA, 20 bp, Artificial Sequence
  Description of Artificial Sequence: Synthetic oligonucleotide
  Target: FXN; (+) strand; PAM type: YTN; PAM sequence: TTT
ttatcagtgtctgcattgct

SEQ ID NO: 35074 - DNA, 20 bp, Artificial Sequence
  Description of Artificial Sequence: Synthetic oligonucleotide
  Target: FXN; (+) strand; PAM type: YTN; PAM sequence: TTT
tatcagtgtctgcattgctg

SEQ ID NO: 35075 - DNA, 20 bp, Artificial Sequence
  Description of Artificial Sequence: Synthetic oligonucleotide
  Target: FXN; (+) strand; PAM type: YTN; PAM sequence: TTT
atcagtgtctgcattgctga

SEQ ID NO: 35076 - DNA, 20 bp, Artificial Sequence
  Description of Artificial Sequence: Synthetic oligonucleotide
  Target: FXN; (+) strand; PAM type: YTN; PAM sequence: TTA
tcagtgtctgcattgctgac

SEQ ID NO: 35077 - DNA, 20 bp, Artificial Sequence
  Description of Artificial Sequence: Synthetic oligonucleotide
  Target: FXN; (+) strand; PAM type: YTN; PAM sequence: CTG
cattgctgacgtctccatca

SEQ ID NO: 35078 - DNA, 20 bp, Artificial Sequence
  Description of Artificial Sequence: Synthetic oligonucleotide
  Target: FXN; (+) strand; PAM type: YTN; PAM sequence: TTG
ctgacgtctccatcatttct

SEQ ID NO: 35079 - DNA, 20 bp, Artificial Sequence
  Description of Artificial Sequence: Synthetic oligonucleotide
  Target: FXN; (+) strand; PAM type: YTN; PAM sequence: CTG
acgtctccatcatttctata

SEQ ID NO: 35080 - DNA, 20 bp, Artificial Sequence
  Description of Artificial Sequence: Synthetic oligonucleotide
  Target: FXN; (+) strand; PAM type: YTN; PAM sequence: CTC
catcatttctatacatttgt

SEQ ID NO: 35081 - DNA, 20 bp, Artificial Sequence
  Description of Artificial Sequence: Synthetic oligonucleotide
  Target: FXN; (+) strand; PAM type: YTN; PAM sequence: TTT
ctatacatttgtttttgaat

SEQ ID NO: 35082 - DNA, 20 bp, Artificial Sequence
  Description of Artificial Sequence: Synthetic oligonucleotide
  Target: FXN; (+) strand; PAM type: YTN; PAM sequence: TTC
tatacatttgtttttgaatc

SEQ ID NO: 35083 - DNA, 20 bp, Artificial Sequence
  Description of Artificial Sequence: Synthetic oligonucleotide
  Target: FXN; (+) strand; PAM type: YTN; PAM sequence: CTA
tacatttgtttttgaatcag

SEQ ID NO: 35084 - DNA, 20 bp, Artificial Sequence
  Description of Artificial Sequence: Synthetic oligonucleotide
  Target: FXN; (+) strand; PAM type: YTN; PAM sequence: TTT
gtttttgaatcagaaaaaga

SEQ ID NO: 35085 - DNA, 20 bp, Artificial Sequence
  Description of Artificial Sequence: Synthetic oligonucleotide
  Target: FXN; (+) strand; PAM type: YTN; PAM sequence: TTG
tttttgaatcagaaaaagat

SEQ ID NO: 35086 - DNA, 20 bp, Artificial Sequence
  Description of Artificial Sequence: Synthetic oligonucleotide
  Target: FXN; (+) strand; PAM type: YTN; PAM sequence: TTT
ttgaatcagaaaaagatgtt

SEQ ID NO: 35087 - DNA, 20 bp, Artificial Sequence
  Description of Artificial Sequence: Synthetic oligonucleotide
  Target: FXN; (+) strand; PAM type: YTN; PAM sequence: TTT
tgaatcagaaaaagatgtta

SEQ ID NO: 35088 - DNA, 20 bp, Artificial Sequence
  Description of Artificial Sequence: Synthetic oligonucleotide
  Target: FXN; (+) strand; PAM type: YTN; PAM sequence: TTT
gaatcagaaaaagatgttat

SEQ ID NO: 35089 - DNA, 20 bp, Artificial Sequence
  Description of Artificial Sequence: Synthetic oligonucleotide
  Target: FXN; (+) strand; PAM type: YTN; PAM sequence: TTG
aatcagaaaaagatgttatt

SEQ ID NO: 35090 - DNA, 20 bp, Artificial Sequence
  Description of Artificial Sequence: Synthetic oligonucleotide
  Target: FXN; (+) strand; PAM type: YTN; PAM sequence: TTA
ttttaaaaaaataacccagt

SEQ ID NO: 35091 - DNA, 20 bp, Artificial Sequence
  Description of Artificial Sequence: Synthetic oligonucleotide
  Target: FXN; (+) strand; PAM type: YTN; PAM sequence: TTT
taaaaaaataacccagtagt

SEQ ID NO: 35092 - DNA, 20 bp, Artificial Sequence
  Description of Artificial Sequence: Synthetic oligonucleotide
  Target: FXN; (+) strand; PAM type: YTN; PAM sequence: TTT
aaaaaaataacccagtagtg

SEQ ID NO: 35093 - DNA, 20 bp, Artificial Sequence
  Description of Artificial Sequence: Synthetic oligonucleotide
  Target: FXN; (+) strand; PAM type: YTN; PAM sequence: TTA
aaaaaataacccagtagtgc

SEQ ID NO: 35094 - DNA, 20 bp, Artificial Sequence
  Description of Artificial Sequence: Synthetic oligonucleotide
  Target: FXN; (+) strand; PAM type: YTN; PAM sequence: CTT
gtcccattcctatcagttat

SEQ ID NO: 35095 - DNA, 20 bp, Artificial Sequence
  Description of Artificial Sequence: Synthetic oligonucleotide
  Target: FXN; (+) strand; PAM type: YTN; PAM sequence: TTG
tcccattcctatcagttata

SEQ ID NO: 35096 - DNA, 20 bp, Artificial Sequence
  Description of Artificial Sequence: Synthetic oligonucleotide
  Target: FXN; (+) strand; PAM type: YTN; PAM sequence: TTC
ctatcagttatattattatt

SEQ ID NO: 35097 - DNA, 20 bp, Artificial Sequence
  Description of Artificial Sequence: Synthetic oligonucleotide
  Target: FXN; (+) strand; PAM type: YTN; PAM sequence: CTA
tcagttatattattattgtt

SEQ ID NO: 35098 - DNA, 20 bp, Artificial Sequence
  Description of Artificial Sequence: Synthetic oligonucleotide
  Target: FXN; (+) strand; PAM type: YTN; PAM sequence: TTA
tattattattgttactaccc

SEQ ID NO: 35099 - DNA, 20 bp, Artificial Sequence
  Description of Artificial Sequence: Synthetic oligonucleotide
  Target: FXN; (+) strand; PAM type: YTN; PAM sequence: TTA
ttattgttactaccctctgg

SEQ ID NO: 35100 - DNA, 20 bp, Artificial Sequence
  Description of Artificial Sequence: Synthetic oligonucleotide
  Target: FXN; (+) strand; PAM type: YTN; PAM sequence: TTA
ttgttactaccctctggaat

SEQ ID NO: 35101 - DNA, 20 bp, Artificial Sequence
  Description of Artificial Sequence: Synthetic oligonucleotide
  Target: FXN; (+) strand; PAM type: YTN; PAM sequence: TTG
ttactaccctctggaatttc

SEQ ID NO: 35102 - DNA, 20 bp, Artificial Sequence
  Description of Artificial Sequence: Synthetic oligonucleotide
  Target: FXN; (+) strand; PAM type: YTN; PAM sequence: TTA
ctaccctctggaatttcaat

SEQ ID NO: 35103 - DNA, 20 bp, Artificial Sequence
  Description of Artificial Sequence: Synthetic oligonucleotide
  Target: FXN; (+) strand; PAM type: YTN; PAM sequence: CTA
ccctctggaatttcaataac

SEQ ID NO: 35104 - DNA, 20 bp, Artificial Sequence
  Description of Artificial Sequence: Synthetic oligonucleotide
  Target: FXN; (+) strand; PAM type: YTN; PAM sequence: CTC
tggaatttcaataactcttt

SEQ ID NO: 35105 - DNA, 20 bp, Artificial Sequence
  Description of Artificial Sequence: Synthetic oligonucleotide
  Target: FXN; (+) strand; PAM type: YTN; PAM sequence: CTG
gaatttcaataactctttgt

SEQ ID NO: 35106 - DNA, 20 bp, Artificial Sequence
  Description of Artificial Sequence: Synthetic oligonucleotide
  Target: FXN; (+) strand; PAM type: YTN; PAM sequence: TTT
caataactctttgttttttg

SEQ ID NO: 35107 - DNA, 20 bp, Artificial Sequence
  Description of Artificial Sequence: Synthetic oligonucleotide
  Target: FXN; (+) strand; PAM type: YTN; PAM sequence: TTC
aataactctttgttttttgg

SEQ ID NO: 35108 - DNA, 20 bp, Artificial Sequence
  Description of Artificial Sequence: Synthetic oligonucleotide
  Target: FXN; (+) strand; PAM type: YTN; PAM sequence: CTC
tttgttttttgggttttttg

SEQ ID NO: 35109 - DNA, 20 bp, Artificial Sequence
  Description of Artificial Sequence: Synthetic oligonucleotide
  Target: FXN; (+) strand; PAM type: YTN; PAM sequence: CTT
tgttttttgggttttttgtt

SEQ ID NO: 35110 - DNA, 20 bp, Artificial Sequence
  Description of Artificial Sequence: Synthetic oligonucleotide
  Target: FXN; (+) strand; PAM type: YTN; PAM sequence: TTT
gttttttgggttttttgttt

SEQ ID NO: 35111 - DNA, 20 bp, Artificial Sequence
  Description of Artificial Sequence: Synthetic oligonucleotide
  Target: FXN; (+) strand; PAM type: YTN; PAM sequence: TTG
ttttttgggttttttgtttt

SEQ ID NO: 35112 - DNA, 20 bp, Artificial Sequence
  Description of Artificial Sequence: Synthetic oligonucleotide
  Target: FXN; (+) strand; PAM type: YTN; PAM sequence: TTT
tttgggttttttgttttgtt

SEQ ID NO: 35113 - DNA, 20 bp, Artificial Sequence
  Description of Artificial Sequence: Synthetic oligonucleotide
  Target: FXN; (+) strand; PAM type: YTN; PAM sequence: TTT
ttgggttttttgttttgttt

SEQ ID NO: 35114 - DNA, 20 bp, Artificial Sequence
  Description of Artificial Sequence: Synthetic oligonucleotide
  Target: FXN; (+) strand; PAM type: YTN; PAM sequence: TTT
tgggttttttgttttgtttt

SEQ ID NO: 35115 - DNA, 20 bp, Artificial Sequence
  Description of Artificial Sequence: Synthetic oligonucleotide
  Target: FXN; (+) strand; PAM type: YTN; PAM sequence: TTT
gggttttttgttttgttttg

SEQ ID NO: 35116 - DNA, 20 bp, Artificial Sequence
  Description of Artificial Sequence: Synthetic oligonucleotide
  Target: FXN; (+) strand; PAM type: YTN; PAM sequence: TTG
ggttttttgttttgttttgc

SEQ ID NO: 35117 - DNA, 20 bp, Artificial Sequence
  Description of Artificial Sequence: Synthetic oligonucleotide
  Target: FXN; (+) strand; PAM type: YTN; PAM sequence: TTT
tttgttttgttttgctttgc

SEQ ID NO: 35118 - DNA, 20 bp, Artificial Sequence
  Description of Artificial Sequence: Synthetic oligonucleotide
  Target: FXN; (+) strand; PAM type: YTN; PAM sequence: TTT
ttgttttgttttgctttgct

SEQ ID NO: 35119 - DNA, 20 bp, Artificial Sequence
  Description of Artificial Sequence: Synthetic oligonucleotide
  Target: FXN; (+) strand; PAM type: YTN; PAM sequence: TTT
tgttttgttttgctttgctt

SEQ ID NO: 35120 - DNA, 20 bp, Artificial Sequence
  Description of Artificial Sequence: Synthetic oligonucleotide
  Target: FXN; (+) strand; PAM type: YTN; PAM sequence: TTT
gttttgttttgctttgcttt

SEQ ID NO: 35121 - DNA, 20 bp, Artificial Sequence
  Description of Artificial Sequence: Synthetic oligonucleotide
  Target: FXN; (+) strand; PAM type: YTN; PAM sequence: TTG
ttttgttttgctttgctttt

SEQ ID NO: 35122 - DNA, 20 bp, Artificial Sequence
  Description of Artificial Sequence: Synthetic oligonucleotide
  Target: FXN; (+) strand; PAM type: YTN; PAM sequence: TTT
tgttttgctttgcttttgag

SEQ ID NO: 35123 - DNA, 20 bp, Artificial Sequence
  Description of Artificial Sequence: Synthetic oligonucleotide
  Target: FXN; (+) strand; PAM type: YTN; PAM sequence: TTT
gttttgctttgcttttgaga

SEQ ID NO: 35124 - DNA, 20 bp, Artificial Sequence
  Description of Artificial Sequence: Synthetic oligonucleotide
  Target: FXN; (+) strand; PAM type: YTN; PAM sequence: TTG
ttttgctttgcttttgagac

SEQ ID NO: 35125 - DNA, 20 bp, Artificial Sequence
  Description of Artificial Sequence: Synthetic oligonucleotide
  Target: FXN; (+) strand; PAM type: YTN; PAM sequence: TTT
tgctttgcttttgagacagg

SEQ ID NO: 35126 - DNA, 20 bp, Artificial Sequence
  Description of Artificial Sequence: Synthetic oligonucleotide
  Target: FXN; (+) strand; PAM type: YTN; PAM sequence: TTT
gctttgcttttgagacagga

SEQ ID NO: 35127 - DNA, 20 bp, Artificial Sequence
  Description of Artificial Sequence: Synthetic oligonucleotide
  Target: FXN; (+) strand; PAM type: YTN; PAM sequence: TTG
ctttgcttttgagacaggat

SEQ ID NO: 35128 - DNA, 20 bp, Artificial Sequence
  Description of Artificial Sequence: Synthetic oligonucleotide
  Target: FXN; (+) strand; PAM type: YTN; PAM sequence: CTT
tgcttttgagacaggatctc

SEQ ID NO: 35129 - DNA, 20 bp, Artificial Sequence
  Description of Artificial Sequence: Synthetic oligonucleotide
  Target: FXN; (+) strand; PAM type: YTN; PAM sequence: TTT
gcttttgagacaggatctct

SEQ ID NO: 35130 - DNA, 20 bp, Artificial Sequence
  Description of Artificial Sequence: Synthetic oligonucleotide
  Target: FXN; (+) strand; PAM type: YTN; PAM sequence: TTG
cttttgagacaggatctctg

SEQ ID NO: 35131 - DNA, 20 bp, Artificial Sequence
  Description of Artificial Sequence: Synthetic oligonucleotide
  Target: FXN; (+) strand; PAM type: YTN; PAM sequence: CTT
ttgagacaggatctctgtcg

SEQ ID NO: 35132 - DNA, 20 bp, Artificial Sequence
  Description of Artificial Sequence: Synthetic oligonucleotide
  Target: FXN; (+) strand; PAM type: YTN; PAM sequence: TTT
tgagacaggatctctgtcgc

SEQ ID NO: 35133 - DNA, 20 bp, Artificial Sequence
  Description of Artificial Sequence: Synthetic oligonucleotide
  Target: FXN; (+) strand; PAM type: YTN; PAM sequence: TTT
gagacaggatctctgtcgcc

SEQ ID NO: 35134 - DNA, 20 bp, Artificial Sequence
  Description of Artificial Sequence: Synthetic oligonucleotide
  Target: FXN; (+) strand; PAM type: YTN; PAM sequence: TTG
agacaggatctctgtcgccc

SEQ ID NO: 35135 - DNA, 20 bp, Artificial Sequence
  Description of Artificial Sequence: Synthetic oligonucleotide
  Target: FXN; (+) strand; PAM type: YTN; PAM sequence: CTC
tgtcgcccagtctggtgtgt

SEQ ID NO: 35136 - DNA, 20 bp, Artificial Sequence
  Description of Artificial Sequence: Synthetic oligonucleotide
  Target: FXN; (+) strand; PAM type: YTN; PAM sequence: CTG
tcgcccagtctggtgtgtag

SEQ ID NO: 35137 - DNA, 20 bp, Artificial Sequence
  Description of Artificial Sequence: Synthetic oligonucleotide
  Target: FXN; (+) strand; PAM type: YTN; PAM sequence: CTG
gtgtgtagtggtgtgatctc

SEQ ID NO: 35138 - DNA, 20 bp, Artificial Sequence
  Description of Artificial Sequence: Synthetic oligonucleotide
  Target: FXN; (+) strand; PAM type: YTN; PAM sequence: CTC
agctcactgcagcctcaacc

SEQ ID NO: 35139 - DNA, 20 bp, Artificial Sequence
  Description of Artificial Sequence: Synthetic oligonucleotide
  Target: FXN; (+) strand; PAM type: YTN; PAM sequence: CTC
actgcagcctcaacctcctg

SEQ ID NO: 35140 - DNA, 20 bp, Artificial Sequence
  Description of Artificial Sequence: Synthetic oligonucleotide
  Target: FXN; (+) strand; PAM type: YTN; PAM sequence: CTG
cagcctcaacctcctgggct

SEQ ID NO: 35141 - DNA, 20 bp, Artificial Sequence
  Description of Artificial Sequence: Synthetic oligonucleotide
  Target: FXN; (+) strand; PAM type: YTN; PAM sequence: CTC
aacctcctgggctcaggtga

SEQ ID NO: 35142 - DNA, 20 bp, Artificial Sequence
  Description of Artificial Sequence: Synthetic oligonucleotide
  Target: FXN; (+) strand; PAM type: YTN; PAM sequence: CTC
ctgggctcaggtgatcctcc

SEQ ID NO: 35143 - DNA, 20 bp, Artificial Sequence
  Description of Artificial Sequence: Synthetic oligonucleotide
  Target: FXN; (+) strand; PAM type: YTN; PAM sequence: CTG
ggctcaggtgatcctcccac

SEQ ID NO: 35144 - DNA, 20 bp, Artificial Sequence
  Description of Artificial Sequence: Synthetic oligonucleotide
  Target: FXN; (+) strand; PAM type: YTN; PAM sequence: CTC
aggtgatcctcccacttcag

SEQ ID NO: 35145 - DNA, 20 bp, Artificial Sequence
  Description of Artificial Sequence: Synthetic oligonucleotide
  Target: FXN; (+) strand; PAM type: YTN; PAM sequence: CTC
ccacttcagcctcccaagta

SEQ ID NO: 35146 - DNA, 20 bp, Artificial Sequence
  Description of Artificial Sequence: Synthetic oligonucleotide
  Target: FXN; (+) strand; PAM type: YTN; PAM sequence: CTT
cagcctcccaagtagctggg

SEQ ID NO: 35147 - DNA, 20 bp, Artificial Sequence
  Description of Artificial Sequence: Synthetic oligonucleotide
  Target: FXN; (+) strand; PAM type: YTN; PAM sequence: TTC
agcctcccaagtagctggga

SEQ ID NO: 35148 - DNA, 20 bp, Artificial Sequence
  Description of Artificial Sequence: Synthetic oligonucleotide
  Target: FXN; (+) strand; PAM type: YTN; PAM sequence: CTC
ccaagtagctgggaccacag

SEQ ID NO: 35149 - DNA, 20 bp, Artificial Sequence
  Description of Artificial Sequence: Synthetic oligonucleotide
  Target: FXN; (+) strand; PAM type: YTN; PAM sequence: CTG
ggaccacaggcgcatgccac

SEQ ID NO: 35150 - DNA, 20 bp, Artificial Sequence
  Description of Artificial Sequence: Synthetic oligonucleotide
  Target: FXN; (+) strand; PAM type: YTN; PAM sequence: CTT
ggctaatttttgcattttta

SEQ ID NO: 35151 - DNA, 20 bp, Artificial Sequence
  Description of Artificial Sequence: Synthetic oligonucleotide
  Target: FXN; (+) strand; PAM type: YTN; PAM sequence: TTG
gctaatttttgcatttttag

SEQ ID NO: 35152 - DNA, 20 bp, Artificial Sequence
  Description of Artificial Sequence: Synthetic oligonucleotide
  Target: FXN; (+) strand; PAM type: YTN; PAM sequence: CTA
atttttgcatttttagtaga

SEQ ID NO: 35153 - DNA, 20 bp, Artificial Sequence
  Description of Artificial Sequence: Synthetic oligonucleotide
  Target: FXN; (+) strand; PAM type: YTN; PAM sequence: TTT
ttgcatttttagtagagaca

SEQ ID NO: 35154 - DNA, 20 bp, Artificial Sequence
  Description of Artificial Sequence: Synthetic oligonucleotide
  Target: FXN; (+) strand; PAM type: YTN; PAM sequence: TTT
tgcatttttagtagagacag

SEQ ID NO: 35155 - DNA, 20 bp, Artificial Sequence
  Description of Artificial Sequence: Synthetic oligonucleotide
  Target: FXN; (+) strand; PAM type: YTN; PAM sequence: TTT
gcatttttagtagagacagg

SEQ ID NO: 35156 - DNA, 20 bp, Artificial Sequence
  Description of Artificial Sequence: Synthetic oligonucleotide
  Target: FXN; (+) strand; PAM type: YTN; PAM sequence: TTG
catttttagtagagacaggg

SEQ ID NO: 35157 - DNA, 20 bp, Artificial Sequence
  Description of Artificial Sequence: Synthetic oligonucleotide
  Target: FXN; (+) strand; PAM type: YTN; PAM sequence: TTT
ttagtagagacagggttttg

SEQ ID NO: 35158 - DNA, 20 bp, Artificial Sequence
  Description of Artificial Sequence: Synthetic oligonucleotide
  Target: FXN; (+) strand; PAM type: YTN; PAM sequence: TTT
tagtagagacagggttttgc

SEQ ID NO: 35159 - DNA, 20 bp, Artificial Sequence
  Description of Artificial Sequence: Synthetic oligonucleotide
  Target: FXN; (+) strand; PAM type: YTN; PAM sequence: TTT
agtagagacagggttttgcc

SEQ ID NO: 35160 - DNA, 20 bp, Artificial Sequence
  Description of Artificial Sequence: Synthetic oligonucleotide
  Target: FXN; (+) strand; PAM type: YTN; PAM sequence: TTA
gtagagacagggttttgcca

SEQ ID NO: 35161 - DNA, 20 bp, Artificial Sequence
  Description of Artificial Sequence: Synthetic oligonucleotide
  Target: FXN; (+) strand; PAM type: YTN; PAM sequence: TTT
tgccatattgcctaggccgg

SEQ ID NO: 35162 - DNA, 20 bp, Artificial Sequence
  Description of Artificial Sequence: Synthetic oligonucleotide
  Target: FXN; (+) strand; PAM type: YTN; PAM sequence: TTT
gccatattgcctaggccggt

SEQ ID NO: 35163 - DNA, 20 bp, Artificial Sequence
  Description of Artificial Sequence: Synthetic oligonucleotide
  Target: FXN; (+) strand; PAM type: YTN; PAM sequence: TTG
ccatattgcctaggccggtc

SEQ ID NO: 35164 - DNA, 20 bp, Artificial Sequence
  Description of Artificial Sequence: Synthetic oligonucleotide
  Target: FXN; (+) strand; PAM type: YTN; PAM sequence: TTG
cctaggccggtctggaactt

SEQ ID NO: 35165 - DNA, 20 bp, Artificial Sequence
  Description of Artificial Sequence: Synthetic oligonucleotide
  Target: FXN; (+) strand; PAM type: YTN; PAM sequence: CTA
ggccggtctggaacttctgg

SEQ ID NO: 35166 - DNA, 20 bp, Artificial Sequence
  Description of Artificial Sequence: Synthetic oligonucleotide
  Target: FXN; (+) strand; PAM type: YTN; PAM sequence: CTG
gaacttctgggctcaagcca

SEQ ID NO: 35167 - DNA, 20 bp, Artificial Sequence
  Description of Artificial Sequence: Synthetic oligonucleotide
  Target: FXN; (+) strand; PAM type: YTN; PAM sequence: CTT
ctgggctcaagccatctgcc

SEQ ID NO: 35168 - DNA, 20 bp, Artificial Sequence
  Description of Artificial Sequence: Synthetic oligonucleotide
  Target: FXN; (+) strand; PAM type: YTN; PAM sequence: TTC
tgggctcaagccatctgcct

SEQ ID NO: 35169 - DNA, 20 bp, Artificial Sequence
  Description of Artificial Sequence: Synthetic oligonucleotide
  Target: FXN; (+) strand; PAM type: YTN; PAM sequence: CTG
ggctcaagccatctgcctgc

SEQ ID NO: 35170 - DNA, 20 bp, Artificial Sequence
  Description of Artificial Sequence: Synthetic oligonucleotide
  Target: FXN; (+) strand; PAM type: YTN; PAM sequence: CTC
aagccatctgcctgcctcgg

SEQ ID NO: 35171 - DNA, 20 bp, Artificial Sequence
  Description of Artificial Sequence: Synthetic oligonucleotide
  Target: FXN; (+) strand; PAM type: YTN; PAM sequence: CTG
cctgcctcggcctcccaaag

SEQ ID NO: 35172 - DNA, 20 bp, Artificial Sequence
  Description of Artificial Sequence: Synthetic oligonucleotide
  Target: FXN; (+) strand; PAM type: YTN; PAM sequence: CTG
cctcggcctcccaaagtgct

SEQ ID NO: 35173 - DNA, 20 bp, Artificial Sequence
  Description of Artificial Sequence: Synthetic oligonucleotide
  Target: FXN; (+) strand; PAM type: YTN; PAM sequence: CTC
ggcctcccaaagtgctggaa

SEQ ID NO: 35174 - DNA, 20 bp, Artificial Sequence
  Description of Artificial Sequence: Synthetic oligonucleotide
  Target: FXN; (+) strand; PAM type: YTN; PAM sequence: CTC
ccaaagtgctggaatttcag

SEQ ID NO: 35175 - DNA, 20 bp, Artificial Sequence
  Description of Artificial Sequence: Synthetic oligonucleotide
  Target: FXN; (+) strand; PAM type: YTN; PAM sequence: CTG
gaatttcaggcatgagccat

SEQ ID NO: 35176 - DNA, 20 bp, Artificial Sequence
  Description of Artificial Sequence: Synthetic oligonucleotide
  Target: FXN; (+) strand; PAM type: YTN; PAM sequence: TTT
caggcatgagccatgcctgg

SEQ ID NO: 35177 - DNA, 20 bp, Artificial Sequence
  Description of Artificial Sequence: Synthetic oligonucleotide
  Target: FXN; (+) strand; PAM type: YTN; PAM sequence: TTC
aggcatgagccatgcctggc

SEQ ID NO: 35178 - DNA, 20 bp, Artificial Sequence
  Description of Artificial Sequence: Synthetic oligonucleotide
  Target: FXN; (+) strand; PAM type: YTN; PAM sequence: CTG
gcctaaatagctctctgtgt

SEQ ID NO: 35179 - DNA, 20 bp, Artificial Sequence
  Description of Artificial Sequence: Synthetic oligonucleotide
  Target: FXN; (+) strand; PAM type: YTN; PAM sequence: CTA
aatagctctctgtgtttgca

SEQ ID NO: 35180 - DNA, 20 bp, Artificial Sequence
  Description of Artificial Sequence: Synthetic oligonucleotide
  Target: FXN; (+) strand; PAM type: YTN; PAM sequence: CTC
tctgtgtttgcaaaagtgtg

SEQ ID NO: 35181 - DNA, 20 bp, Artificial Sequence
  Description of Artificial Sequence: Synthetic oligonucleotide
  Target: FXN; (+) strand; PAM type: YTN; PAM sequence: CTC
tgtgtttgcaaaagtgtgtt

SEQ ID NO: 35182 - DNA, 20 bp, Artificial Sequence
  Description of Artificial Sequence: Synthetic oligonucleotide
  Target: FXN; (+) strand; PAM type: YTN; PAM sequence: CTG
tgtttgcaaaagtgtgttat

SEQ ID NO: 35183 - DNA, 20 bp, Artificial Sequence
  Description of Artificial Sequence: Synthetic oligonucleotide
  Target: FXN; (+) strand; PAM type: YTN; PAM sequence: TTT
gcaaaagtgtgttataagaa

SEQ ID NO: 35184 - DNA, 20 bp, Artificial Sequence
  Description of Artificial Sequence: Synthetic oligonucleotide
  Target: FXN; (+) strand; PAM type: YTN; PAM sequence: TTG
caaaagtgtgttataagaat

SEQ ID NO: 35185 - DNA, 20 bp, Artificial Sequence
  Description of Artificial Sequence: Synthetic oligonucleotide
  Target: FXN; (+) strand; PAM type: YTN; PAM sequence: TTA
taagaatcattcagagcctc

SEQ ID NO: 35186 - DNA, 20 bp, Artificial Sequence
  Description of Artificial Sequence: Synthetic oligonucleotide
  Target: FXN; (+) strand; PAM type: YTN; PAM sequence: TTC
agagcctctcgattggatgg

SEQ ID NO: 35187 - DNA, 20 bp, Artificial Sequence
  Description of Artificial Sequence: Synthetic oligonucleotide
  Target: FXN; (+) strand; PAM type: YTN; PAM sequence: CTC
tcgattggatggaggctcta

SEQ ID NO: 35188 - DNA, 20 bp, Artificial Sequence
  Description of Artificial Sequence: Synthetic oligonucleotide
  Target: FXN; (+) strand; PAM type: YTN; PAM sequence: CTC
gattggatggaggctctaga

SEQ ID NO: 35189 - DNA, 20 bp, Artificial Sequence
  Description of Artificial Sequence: Synthetic oligonucleotide
  Target: FXN; (+) strand; PAM type: YTN; PAM sequence: TTG
gatggaggctctagaatgca

SEQ ID NO: 35190 - DNA, 20 bp, Artificial Sequence
  Description of Artificial Sequence: Synthetic oligonucleotide
  Target: FXN; (+) strand; PAM type: YTN; PAM sequence: CTC
tagaatgcacagaaaaaggc

SEQ ID NO: 35191 - DNA, 20 bp, Artificial Sequence
  Description of Artificial Sequence: Synthetic oligonucleotide
  Target: FXN; (+) strand; PAM type: YTN; PAM sequence: CTA
gaatgcacagaaaaaggctg

SEQ ID NO: 35192 - DNA, 20 bp, Artificial Sequence
  Description of Artificial Sequence: Synthetic oligonucleotide
  Target: FXN; (+) strand; PAM type: YTN; PAM sequence: CTG
ccaccgtgtatctctgcaag

SEQ ID NO: 35193 - DNA, 20 bp, Artificial Sequence
  Description of Artificial Sequence: Synthetic oligonucleotide
  Target: FXN; (+) strand; PAM type: YTN; PAM sequence: CTC
tgcaagtcatgcacaagatg

SEQ ID NO: 35194 - DNA, 20 bp, Artificial Sequence
  Description of Artificial Sequence: Synthetic oligonucleotide
  Target: FXN; (+) strand; PAM type: YTN; PAM sequence: CTG
caagtcatgcacaagatggg

SEQ ID NO: 35195 - DNA, 20 bp, Artificial Sequence
  Description of Artificial Sequence: Synthetic oligonucleotide
  Target: FXN; (+) strand; PAM type: YTN; PAM sequence: CTT
ccccctgcttaccagttcaa

SEQ ID NO: 35196 - DNA, 20 bp, Artificial Sequence
  Description of Artificial Sequence: Synthetic oligonucleotide
  Target: FXN; (+) strand; PAM type: YTN; PAM sequence: TTC
cccctgcttaccagttcaaa

SEQ ID NO: 35197 - DNA, 20 bp, Artificial Sequence
  Description of Artificial Sequence: Synthetic oligonucleotide
  Target: FXN; (+) strand; PAM type: YTN; PAM sequence: CTG
cttaccagttcaaatacaga

SEQ ID NO: 35198 - DNA, 20 bp, Artificial Sequence
  Description of Artificial Sequence: Synthetic oligonucleotide
  Target: FXN; (+) strand; PAM type: YTN; PAM sequence: CTT
accagttcaaatacagagaa

SEQ ID NO: 35199 - DNA, 20 bp, Artificial Sequence
  Description of Artificial Sequence: Synthetic oligonucleotide
  Target: FXN; (+) strand; PAM type: YTN; PAM sequence: TTA
ccagttcaaatacagagaac

SEQ ID NO: 35200 - DNA, 20 bp, Artificial Sequence
  Description of Artificial Sequence: Synthetic oligonucleotide
  Target: FXN; (+) strand; PAM type: YTN; PAM sequence: TTC
aaatacagagaactagccct

SEQ ID NO: 35201 - DNA, 20 bp, Artificial Sequence
  Description of Artificial Sequence: Synthetic oligonucleotide
  Target: FXN; (+) strand; PAM type: YTN; PAM sequence: CTA
gccctgtagctgtttctttc

SEQ ID NO: 35202 - DNA, 20 bp, Artificial Sequence
  Description of Artificial Sequence: Synthetic oligonucleotide
  Target: FXN; (+) strand; PAM type: YTN; PAM sequence: CTG
tagctgtttctttcatatct

SEQ ID NO: 35203 - DNA, 20 bp, Artificial Sequence
  Description of Artificial Sequence: Synthetic oligonucleotide
  Target: FXN; (+) strand; PAM type: YTN; PAM sequence: CTG
tttctttcatatctcaccca

SEQ ID NO: 35204 - DNA, 20 bp, Artificial Sequence
  Description of Artificial Sequence: Synthetic oligonucleotide
  Target: FXN; (+) strand; PAM type: YTN; PAM sequence: TTT
ctttcatatctcacccattc

SEQ ID NO: 35205 - DNA, 20 bp, Artificial Sequence
  Description of Artificial Sequence: Synthetic oligonucleotide
  Target: FXN; (+) strand; PAM type: YTN; PAM sequence: TTC
tttcatatctcacccattct

SEQ ID NO: 35206 - DNA, 20 bp, Artificial Sequence
  Description of Artificial Sequence: Synthetic oligonucleotide
  Target: FXN; (+) strand; PAM type: YTN; PAM sequence: CTT
tcatatctcacccattctaa

SEQ ID NO: 35207 - DNA, 20 bp, Artificial Sequence
  Description of Artificial Sequence: Synthetic oligonucleotide
  Target: FXN; (+) strand; PAM type: YTN; PAM sequence: TTT
catatctcacccattctaaa

SEQ ID NO: 35208 - DNA, 20 bp, Artificial Sequence
  Description of Artificial Sequence: Synthetic oligonucleotide
  Target: FXN; (+) strand; PAM type: YTN; PAM sequence: TTC
atatctcacccattctaaag

SEQ ID NO: 35209 - DNA, 20 bp, Artificial Sequence
  Description of Artificial Sequence: Synthetic oligonucleotide
  Target: FXN; (+) strand; PAM type: YTN; PAM sequence: CTC
acccattctaaagagaccac

SEQ ID NO: 35210 - DNA, 20 bp, Artificial Sequence
  Description of Artificial Sequence: Synthetic oligonucleotide
  Target: FXN; (+) strand; PAM type: YTN; PAM sequence: TTC
taaagagaccacaggcctta

SEQ ID NO: 35211 - DNA, 20 bp, Artificial Sequence
  Description of Artificial Sequence: Synthetic oligonucleotide
  Target: FXN; (+) strand; PAM type: YTN; PAM sequence: CTA
aagagaccacaggccttaga

SEQ ID NO: 35212 - DNA, 20 bp, Artificial Sequence
  Description of Artificial Sequence: Synthetic oligonucleotide
  Target: FXN; (+) strand; PAM type: YTN; PAM sequence: CTT
agaagtaaaggactcttttg

SEQ ID NO: 35213 - DNA, 20 bp, Artificial Sequence
  Description of Artificial Sequence: Synthetic oligonucleotide
  Target: FXN; (+) strand; PAM type: YTN; PAM sequence: TTA
gaagtaaaggactcttttgt

SEQ ID NO: 35214 - DNA, 20 bp, Artificial Sequence
  Description of Artificial Sequence: Synthetic oligonucleotide
  Target: FXN; (+) strand; PAM type: YTN; PAM sequence: CTC
ttttgttgaaagagtgtttt

SEQ ID NO: 35215 - DNA, 20 bp, Artificial Sequence
  Description of Artificial Sequence: Synthetic oligonucleotide
  Target: FXN; (+) strand; PAM type: YTN; PAM sequence: CTT
ttgttgaaagagtgttttca

SEQ ID NO: 35216 - DNA, 20 bp, Artificial Sequence
  Description of Artificial Sequence: Synthetic oligonucleotide
  Target: FXN; (+) strand; PAM type: YTN; PAM sequence: TTT
tgttgaaagagtgttttcaa

SEQ ID NO: 35217 - DNA, 20 bp, Artificial Sequence
  Description of Artificial Sequence: Synthetic oligonucleotide
  Target: FXN; (+) strand; PAM type: YTN; PAM sequence: TTT
gttgaaagagtgttttcaaa

SEQ ID NO: 35218 - DNA, 20 bp, Artificial Sequence
  Description of Artificial Sequence: Synthetic oligonucleotide
  Target: FXN; (+) strand; PAM type: YTN; PAM sequence: TTG
ttgaaagagtgttttcaaat

SEQ ID NO: 35219 - DNA, 20 bp, Artificial Sequence
  Description of Artificial Sequence: Synthetic oligonucleotide
  Target: FXN; (+) strand; PAM type: YTN; PAM sequence: TTG
aaagagtgttttcaaattta

SEQ ID NO: 35220 - DNA, 20 bp, Artificial Sequence
  Description of Artificial Sequence: Synthetic oligonucleotide
  Target: FXN; (+) strand; PAM type: YTN; PAM sequence: TTT
tcaaatttaaatgagcattt

SEQ ID NO: 35221 - DNA, 20 bp, Artificial Sequence
  Description of Artificial Sequence: Synthetic oligonucleotide
  Target: FXN; (+) strand; PAM type: YTN; PAM sequence: TTT
caaatttaaatgagcattta

SEQ ID NO: 35222 - DNA, 20 bp, Artificial Sequence
  Description of Artificial Sequence: Synthetic oligonucleotide
  Target: FXN; (+) strand; PAM type: YTN; PAM sequence: TTC
aaatttaaatgagcatttat

SEQ ID NO: 35223 - DNA, 20 bp, Artificial Sequence
  Description of Artificial Sequence: Synthetic oligonucleotide
  Target: FXN; (+) strand; PAM type: YTN; PAM sequence: TTT
aaatgagcatttattggtca

SEQ ID NO: 35224 - DNA, 20 bp, Artificial Sequence
  Description of Artificial Sequence: Synthetic oligonucleotide
  Target: FXN; (+) strand; PAM type: YTN; PAM sequence: TTA
aatgagcatttattggtcaa

SEQ ID NO: 35225 - DNA, 20 bp, Artificial Sequence
  Description of Artificial Sequence: Synthetic oligonucleotide
  Target: FXN; (+) strand; PAM type: YTN; PAM sequence: TTT
attggtcaaagatgcaccaa

SEQ ID NO: 35226 - DNA, 20 bp, Artificial Sequence
  Description of Artificial Sequence: Synthetic oligonucleotide
  Target: FXN; (+) strand; PAM type: YTN; PAM sequence: TTA
ttggtcaaagatgcaccaac

SEQ ID NO: 35227 - DNA, 20 bp, Artificial Sequence
  Description of Artificial Sequence: Synthetic oligonucleotide
  Target: FXN; (+) strand; PAM type: YTN; PAM sequence: TTG
gtcaaagatgcaccaactag

SEQ ID NO: 35228 - DNA, 20 bp, Artificial Sequence
  Description of Artificial Sequence: Synthetic oligonucleotide
  Target: FXN; (+) strand; PAM type: YTN; PAM sequence: CTA
gtcttttgaagaattcaagg

SEQ ID NO: 35229 - DNA, 20 bp, Artificial Sequence
  Description of Artificial Sequence: Synthetic oligonucleotide
  Target: FXN; (+) strand; PAM type: YTN; PAM sequence: CTT
ttgaagaattcaaggctctt

SEQ ID NO: 35230 - DNA, 20 bp, Artificial Sequence
  Description of Artificial Sequence: Synthetic oligonucleotide
  Target: FXN; (+) strand; PAM type: YTN; PAM sequence: TTT
tgaagaattcaaggctcttt

SEQ ID NO: 35231 - DNA, 20 bp, Artificial Sequence
  Description of Artificial Sequence: Synthetic oligonucleotide
  Target: FXN; (+) strand; PAM type: YTN; PAM sequence: TTT
gaagaattcaaggctcttta

SEQ ID NO: 35232 - DNA, 20 bp, Artificial Sequence
  Description of Artificial Sequence: Synthetic oligonucleotide
  Target: FXN; (+) strand; PAM type: YTN; PAM sequence: TTG
aagaattcaaggctctttag

SEQ ID NO: 35233 - DNA, 20 bp, Artificial Sequence
  Description of Artificial Sequence: Synthetic oligonucleotide
  Target: FXN; (+) strand; PAM type: YTN; PAM sequence: TTC
aaggctctttagagaaaaat

SEQ ID NO: 35234 - DNA, 20 bp, Artificial Sequence
  Description of Artificial Sequence: Synthetic oligonucleotide
  Target: FXN; (+) strand; PAM type: YTN; PAM sequence: CTC
tttagagaaaaataaagcct

SEQ ID NO: 35235 - DNA, 20 bp, Artificial Sequence
  Description of Artificial Sequence: Synthetic oligonucleotide
  Target: FXN; (+) strand; PAM type: YTN; PAM sequence: CTT
tagagaaaaataaagccttg

SEQ ID NO: 35236 - DNA, 20 bp, Artificial Sequence
  Description of Artificial Sequence: Synthetic oligonucleotide
  Target: FXN; (+) strand; PAM type: YTN; PAM sequence: TTT
agagaaaaataaagccttgg

SEQ ID NO: 35237 - DNA, 20 bp, Artificial Sequence
  Description of Artificial Sequence: Synthetic oligonucleotide
  Target: FXN; (+) strand; PAM type: YTN; PAM sequence: TTA
gagaaaaataaagccttgga

SEQ ID NO: 35238 - DNA, 20 bp, Artificial Sequence
  Description of Artificial Sequence: Synthetic oligonucleotide
  Target: FXN; (+) strand; PAM type: YTN; PAM sequence: CTT
ggaggagtatctgagaagct

SEQ ID NO: 35239 - DNA, 20 bp, Artificial Sequence
  Description of Artificial Sequence: Synthetic oligonucleotide
  Target: FXN; (+) strand; PAM type: YTN; PAM sequence: TTG
gaggagtatctgagaagctt

SEQ ID NO: 35240 - DNA, 20 bp, Artificial Sequence
  Description of Artificial Sequence: Synthetic oligonucleotide
  Target: FXN; (+) strand; PAM type: YTN; PAM sequence: CTG
agaagcttgttagatgcgtg

SEQ ID NO: 35241 - DNA, 20 bp, Artificial Sequence
  Description of Artificial Sequence: Synthetic oligonucleotide
  Target: FXN; (+) strand; PAM type: YTN; PAM sequence: CTT
gttagatgcgtgggaagagt

SEQ ID NO: 35242 - DNA, 20 bp, Artificial Sequence
  Description of Artificial Sequence: Synthetic oligonucleotide
  Target: FXN; (+) strand; PAM type: YTN; PAM sequence: TTG
ttagatgcgtgggaagagtc

SEQ ID NO: 35243 - DNA, 20 bp, Artificial Sequence
  Description of Artificial Sequence: Synthetic oligonucleotide
  Target: FXN; (+) strand; PAM type: YTN; PAM sequence: TTA
gatgcgtgggaagagtctgg

SEQ ID NO: 35244 - DNA, 20 bp, Artificial Sequence
  Description of Artificial Sequence: Synthetic oligonucleotide
  Target: FXN; (+) strand; PAM type: YTN; PAM sequence: CTG
gaaataaaaaacttcatctg

SEQ ID NO: 35245 - DNA, 20 bp, Artificial Sequence
  Description of Artificial Sequence: Synthetic oligonucleotide
  Target: FXN; (+) strand; PAM type: YTN; PAM sequence: CTT
catctggagtttctgccttc

SEQ ID NO: 35246 - DNA, 20 bp, Artificial Sequence
  Description of Artificial Sequence: Synthetic oligonucleotide
  Target: FXN; (+) strand; PAM type: YTN; PAM sequence: TTC
atctggagtttctgccttct

SEQ ID NO: 35247 - DNA, 20 bp, Artificial Sequence
  Description of Artificial Sequence: Synthetic oligonucleotide
  Target: FXN; (+) strand; PAM type: YTN; PAM sequence: CTG
gagtttctgccttctaccaa

SEQ ID NO: 35248 - DNA, 20 bp, Artificial Sequence
  Description of Artificial Sequence: Synthetic oligonucleotide
  Target: FXN; (+) strand; PAM type: YTN; PAM sequence: TTT
ctgccttctaccaacagagc

SEQ ID NO: 35249 - DNA, 20 bp, Artificial Sequence
  Description of Artificial Sequence: Synthetic oligonucleotide
  Target: FXN; (+) strand; PAM type: YTN; PAM sequence: TTC
tgccttctaccaacagagct

SEQ ID NO: 35250 - DNA, 20 bp, Artificial Sequence
  Description of Artificial Sequence: Synthetic oligonucleotide
  Target: FXN; (+) strand; PAM type: YTN; PAM sequence: CTG
ccttctaccaacagagctga

SEQ ID NO: 35251 - DNA, 20 bp, Artificial Sequence
  Description of Artificial Sequence: Synthetic oligonucleotide
  Target: FXN; (+) strand; PAM type: YTN; PAM sequence: CTT
ctaccaacagagctgaagct

SEQ ID NO: 35252 - DNA, 20 bp, Artificial Sequence
  Description of Artificial Sequence: Synthetic oligonucleotide
  Target: FXN; (+) strand; PAM type: YTN; PAM sequence: TTC
taccaacagagctgaagcta

SEQ ID NO: 35253 - DNA, 20 bp, Artificial Sequence
  Description of Artificial Sequence: Synthetic oligonucleotide
  Target: FXN; (+) strand; PAM type: YTN; PAM sequence: CTA
ccaacagagctgaagctaat

SEQ ID NO: 35254 - DNA, 20 bp, Artificial Sequence
  Description of Artificial Sequence: Synthetic oligonucleotide
  Target: FXN; (+) strand; PAM type: YTN; PAM sequence: CTG
aagctaatgctctcctaaga

SEQ ID NO: 35255 - DNA, 20 bp, Artificial Sequence
  Description of Artificial Sequence: Synthetic oligonucleotide
  Target: FXN; (+) strand; PAM type: YTN; PAM sequence: CTA
atgctctcctaagacaagca

SEQ ID NO: 35256 - DNA, 20 bp, Artificial Sequence
  Description of Artificial Sequence: Synthetic oligonucleotide
  Target: FXN; (+) strand; PAM type: YTN; PAM sequence: CTC
tcctaagacaagcaaagcag

SEQ ID NO: 35257 - DNA, 20 bp, Artificial Sequence
  Description of Artificial Sequence: Synthetic oligonucleotide
  Target: FXN; (+) strand; PAM type: YTN; PAM sequence: CTC
ctaagacaagcaaagcagat

SEQ ID NO: 35258 - DNA, 20 bp, Artificial Sequence
  Description of Artificial Sequence: Synthetic oligonucleotide
  Target: FXN; (+) strand; PAM type: YTN; PAM sequence: CTA
agacaagcaaagcagatggt

SEQ ID NO: 35259 - DNA, 20 bp, Artificial Sequence
  Description of Artificial Sequence: Synthetic oligonucleotide
  Target: FXN; (+) strand; PAM type: YTN; PAM sequence: TTT
gcatacttccttaccttcct

SEQ ID NO: 35260 - DNA, 20 bp, Artificial Sequence
  Description of Artificial Sequence: Synthetic oligonucleotide
  Target: FXN; (+) strand; PAM type: YTN; PAM sequence: TTG
catacttccttaccttcctt

SEQ ID NO: 35261 - DNA, 20 bp, Artificial Sequence
  Description of Artificial Sequence: Synthetic oligonucleotide
  Target: FXN; (+) strand; PAM type: YTN; PAM sequence: CTT
ccttaccttccttttacttc

SEQ ID NO: 35262 - DNA, 20 bp, Artificial Sequence
  Description of Artificial Sequence: Synthetic oligonucleotide
  Target: FXN; (+) strand; PAM type: YTN; PAM sequence: TTC
cttaccttccttttacttcc

SEQ ID NO: 35263 - DNA, 20 bp, Artificial Sequence
  Description of Artificial Sequence: Synthetic oligonucleotide
  Target: FXN; (+) strand; PAM type: YTN; PAM sequence: CTT
accttccttttacttcctct

SEQ ID NO: 35264 - DNA, 20 bp, Artificial Sequence
  Description of Artificial Sequence: Synthetic oligonucleotide
  Target: FXN; (+) strand; PAM type: YTN; PAM sequence: TTA
ccttccttttacttcctctg

SEQ ID NO: 35265 - DNA, 20 bp, Artificial Sequence
  Description of Artificial Sequence: Synthetic oligonucleotide
  Target: FXN; (+) strand; PAM type: YTN; PAM sequence: CTT
ccttttacttcctctgtaat

SEQ ID NO: 35266 - DNA, 20 bp, Artificial Sequence
  Description of Artificial Sequence: Synthetic oligonucleotide
  Target: FXN; (+) strand; PAM type: YTN; PAM sequence: TTC
cttttacttcctctgtaata

SEQ ID NO: 35267 - DNA, 20 bp, Artificial Sequence
  Description of Artificial Sequence: Synthetic oligonucleotide
  Target: FXN; (+) strand; PAM type: YTN; PAM sequence: CTT
ttacttcctctgtaatagac

SEQ ID NO: 35268 - DNA, 20 bp, Artificial Sequence
  Description of Artificial Sequence: Synthetic oligonucleotide
  Target: FXN; (+) strand; PAM type: YTN; PAM sequence: TTT
tacttcctctgtaatagact

SEQ ID NO: 35269 - DNA, 20 bp, Artificial Sequence
  Description of Artificial Sequence: Synthetic oligonucleotide
  Target: FXN; (+) strand; PAM type: YTN; PAM sequence: TTT
acttcctctgtaatagactt

SEQ ID NO: 35270 - DNA, 20 bp, Artificial Sequence
  Description of Artificial Sequence: Synthetic oligonucleotide
  Target: FXN; (+) strand; PAM type: YTN; PAM sequence: TTA
cttcctctgtaatagacttg

SEQ ID NO: 35271 - DNA, 20 bp, Artificial Sequence
  Description of Artificial Sequence: Synthetic oligonucleotide
  Target: FXN; (+) strand; PAM type: YTN; PAM sequence: CTT
cctctgtaatagacttgtca

SEQ ID NO: 35272 - DNA, 20 bp, Artificial Sequence
  Description of Artificial Sequence: Synthetic oligonucleotide
  Target: FXN; (+) strand; PAM type: YTN; PAM sequence: TTC
ctctgtaatagacttgtcat

SEQ ID NO: 35273 - DNA, 20 bp, Artificial Sequence
  Description of Artificial Sequence: Synthetic oligonucleotide
  Target: FXN; (+) strand; PAM type: YTN; PAM sequence: CTC
tgtaatagacttgtcatgtc

SEQ ID NO: 35274 - DNA, 20 bp, Artificial Sequence
  Description of Artificial Sequence: Synthetic oligonucleotide
  Target: FXN; (+) strand; PAM type: YTN; PAM sequence: CTG
taatagacttgtcatgtctg

SEQ ID NO: 35275 - DNA, 20 bp, Artificial Sequence
  Description of Artificial Sequence: Synthetic oligonucleotide
  Target: FXN; (+) strand; PAM type: YTN; PAM sequence: CTT
gtcatgtctgatgtttgagt

SEQ ID NO: 35276 - DNA, 20 bp, Artificial Sequence
  Description of Artificial Sequence: Synthetic oligonucleotide
  Target: FXN; (+) strand; PAM type: YTN; PAM sequence: TTG
tcatgtctgatgtttgagtt

SEQ ID NO: 35277 - DNA, 20 bp, Artificial Sequence
  Description of Artificial Sequence: Synthetic oligonucleotide
  Target: FXN; (+) strand; PAM type: YTN; PAM sequence: CTG
atgtttgagttgacgtggta

SEQ ID NO: 35278 - DNA, 20 bp, Artificial Sequence
  Description of Artificial Sequence: Synthetic oligonucleotide
  Target: FXN; (+) strand; PAM type: YTN; PAM sequence: TTT
gagttgacgtggtactctaa

SEQ ID NO: 35279 - DNA, 20 bp, Artificial Sequence
  Description of Artificial Sequence: Synthetic oligonucleotide
  Target: FXN; (+) strand; PAM type: YTN; PAM sequence: TTG
agttgacgtggtactctaat

SEQ ID NO: 35280 - DNA, 20 bp, Artificial Sequence
  Description of Artificial Sequence: Synthetic oligonucleotide
  Target: FXN; (+) strand; PAM type: YTN; PAM sequence: TTG
acgtggtactctaatagagt

SEQ ID NO: 35281 - DNA, 20 bp, Artificial Sequence
  Description of Artificial Sequence: Synthetic oligonucleotide
  Target: FXN; (+) strand; PAM type: YTN; PAM sequence: CTC
taatagagttagagtctgca

SEQ ID NO: 35282 - DNA, 20 bp, Artificial Sequence
  Description of Artificial Sequence: Synthetic oligonucleotide
  Target: FXN; (+) strand; PAM type: YTN; PAM sequence: CTA
atagagttagagtctgcatt

SEQ ID NO: 35283 - DNA, 20 bp, Artificial Sequence
  Description of Artificial Sequence: Synthetic oligonucleotide
  Target: FXN; (+) strand; PAM type: YTN; PAM sequence: TTA
gagtctgcattttttttatg

SEQ ID NO: 35284 - DNA, 20 bp, Artificial Sequence
  Description of Artificial Sequence: Synthetic oligonucleotide
  Target: FXN; (+) strand; PAM type: YTN; PAM sequence: CTG
cattttttttatgtcctcta

SEQ ID NO: 35285 - DNA, 20 bp, Artificial Sequence
  Description of Artificial Sequence: Synthetic oligonucleotide
  Target: FXN; (+) strand; PAM type: YTN; PAM sequence: TTT
tttttatgtcctctagtatg

SEQ ID NO: 35286 - DNA, 20 bp, Artificial Sequence
  Description of Artificial Sequence: Synthetic oligonucleotide
  Target: FXN; (+) strand; PAM type: YTN; PAM sequence: TTT
ttttatgtcctctagtatgt

SEQ ID NO: 35287 - DNA, 20 bp, Artificial Sequence
  Description of Artificial Sequence: Synthetic oligonucleotide
  Target: FXN; (+) strand; PAM type: YTN; PAM sequence: TTT
tttatgtcctctagtatgtt

SEQ ID NO: 35288 - DNA, 20 bp, Artificial Sequence
  Description of Artificial Sequence: Synthetic oligonucleotide
  Target: FXN; (+) strand; PAM type: YTN; PAM sequence: TTT
ttatgtcctctagtatgttc

SEQ ID NO: 35289 - DNA, 20 bp, Artificial Sequence
  Description of Artificial Sequence: Synthetic oligonucleotide
  Target: FXN; (+) strand; PAM type: YTN; PAM sequence: TTT
tatgtcctctagtatgttct

SEQ ID NO: 35290 - DNA, 20 bp, Artificial Sequence
  Description of Artificial Sequence: Synthetic oligonucleotide
  Target: FXN; (+) strand; PAM type: YTN; PAM sequence: TTT
atgtcctctagtatgttctg

SEQ ID NO: 35291 - DNA, 20 bp, Artificial Sequence
  Description of Artificial Sequence: Synthetic oligonucleotide
  Target: FXN; (+) strand; PAM type: YTN; PAM sequence: TTA
tgtcctctagtatgttctgg

SEQ ID NO: 35292 - DNA, 20 bp, Artificial Sequence
  Description of Artificial Sequence: Synthetic oligonucleotide
  Target: FXN; (+) strand; PAM type: YTN; PAM sequence: CTC
tagtatgttctggttgatgg

SEQ ID NO: 35293 - DNA, 20 bp, Artificial Sequence
  Description of Artificial Sequence: Synthetic oligonucleotide
  Target: FXN; (+) strand; PAM type: YTN; PAM sequence: CTA
gtatgttctggttgatggtt

SEQ ID NO: 35294 - DNA, 20 bp, Artificial Sequence
  Description of Artificial Sequence: Synthetic oligonucleotide
  Target: FXN; (+) strand; PAM type: YTN; PAM sequence: TTC
tggttgatggttgagggcaa

SEQ ID NO: 35295 - DNA, 20 bp, Artificial Sequence
  Description of Artificial Sequence: Synthetic oligonucleotide
  Target: FXN; (+) strand; PAM type: YTN; PAM sequence: CTG
gttgatggttgagggcaaca

SEQ ID NO: 35296 - DNA, 20 bp, Artificial Sequence
  Description of Artificial Sequence: Synthetic oligonucleotide
  Target: FXN; (+) strand; PAM type: YTN; PAM sequence: TTG
atggttgagggcaacaaacc

SEQ ID NO: 35297 - DNA, 20 bp, Artificial Sequence
  Description of Artificial Sequence: Synthetic oligonucleotide
  Target: FXN; (+) strand; PAM type: YTN; PAM sequence: TTG
agggcaacaaaccagcagtc

SEQ ID NO: 35298 - DNA, 20 bp, Artificial Sequence
  Description of Artificial Sequence: Synthetic oligonucleotide
  Target: FXN; (+) strand; PAM type: YTN; PAM sequence: CTG
agacaggtcacttaactctc

SEQ ID NO: 35299 - DNA, 20 bp, Artificial Sequence
  Description of Artificial Sequence: Synthetic oligonucleotide
  Target: FXN; (+) strand; PAM type: YTN; PAM sequence: CTT
aactctccgagcttcaccac

SEQ ID NO: 35300 - DNA, 20 bp, Artificial Sequence
  Description of Artificial Sequence: Synthetic oligonucleotide
  Target: FXN; (+) strand; PAM type: YTN; PAM sequence: TTA
actctccgagcttcaccacc

SEQ ID NO: 35301 - DNA, 20 bp, Artificial Sequence
  Description of Artificial Sequence: Synthetic oligonucleotide
  Target: FXN; (+) strand; PAM type: YTN; PAM sequence: CTC
tccgagcttcaccaccattc

SEQ ID NO: 35302 - DNA, 20 bp, Artificial Sequence
  Description of Artificial Sequence: Synthetic oligonucleotide
  Target: FXN; (+) strand; PAM type: YTN; PAM sequence: CTC
cgagcttcaccaccattctc

SEQ ID NO: 35303 - DNA, 20 bp, Artificial Sequence
  Description of Artificial Sequence: Synthetic oligonucleotide
  Target: FXN; (+) strand; PAM type: YTN; PAM sequence: CTT
caccaccattctcaccttgc

SEQ ID NO: 35304 - DNA, 20 bp, Artificial Sequence
  Description of Artificial Sequence: Synthetic oligonucleotide
  Target: FXN; (+) strand; PAM type: YTN; PAM sequence: TTC
accaccattctcaccttgca

SEQ ID NO: 35305 - DNA, 20 bp, Artificial Sequence
  Description of Artificial Sequence: Synthetic oligonucleotide
  Target: FXN; (+) strand; PAM type: YTN; PAM sequence: TTC
tcaccttgcagacctcacag

SEQ ID NO: 35306 - DNA, 20 bp, Artificial Sequence
  Description of Artificial Sequence: Synthetic oligonucleotide
  Target: FXN; (+) strand; PAM type: YTN; PAM sequence: CTC
accttgcagacctcacaggg

SEQ ID NO: 35307 - DNA, 20 bp, Artificial Sequence
  Description of Artificial Sequence: Synthetic oligonucleotide
  Target: FXN; (+) strand; PAM type: YTN; PAM sequence: CTT
gcagacctcacagggaacag

SEQ ID NO: 35308 - DNA, 20 bp, Artificial Sequence
  Description of Artificial Sequence: Synthetic oligonucleotide
  Target: FXN; (+) strand; PAM type: YTN; PAM sequence: TTG
cagacctcacagggaacagg

SEQ ID NO: 35309 - DNA, 20 bp, Artificial Sequence
  Description of Artificial Sequence: Synthetic oligonucleotide
  Target: FXN; (+) strand; PAM type: YTN; PAM sequence: CTC
acagggaacagggaaagctc

SEQ ID NO: 35310 - DNA, 20 bp, Artificial Sequence
  Description of Artificial Sequence: Synthetic oligonucleotide
  Target: FXN; (+) strand; PAM type: YTN; PAM sequence: CTC
tatgagatacaacatcatta

SEQ ID NO: 35311 - DNA, 20 bp, Artificial Sequence
  Description of Artificial Sequence: Synthetic oligonucleotide
  Target: FXN; (+) strand; PAM type: YTN; PAM sequence: CTA
tgagatacaacatcattatg

SEQ ID NO: 35312 - DNA, 20 bp, Artificial Sequence
  Description of Artificial Sequence: Synthetic oligonucleotide
  Target: FXN; (+) strand; PAM type: YTN; PAM sequence: TTA
tgattaatcctattctgatt

SEQ ID NO: 35313 - DNA, 20 bp, Artificial Sequence
  Description of Artificial Sequence: Synthetic oligonucleotide
  Target: FXN; (+) strand; PAM type: YTN; PAM sequence: TTA
atcctattctgattctgaaa

SEQ ID NO: 35314 - DNA, 20 bp, Artificial Sequence
  Description of Artificial Sequence: Synthetic oligonucleotide
  Target: FXN; (+) strand; PAM type: YTN; PAM sequence: CTA
ttctgattctgaaagcaaag

SEQ ID NO: 35315 - DNA, 20 bp, Artificial Sequence
  Description of Artificial Sequence: Synthetic oligonucleotide
  Target: FXN; (+) strand; PAM type: YTN; PAM sequence: TTC
tgattctgaaagcaaagctc

SEQ ID NO: 35316 - DNA, 20 bp, Artificial Sequence
  Description of Artificial Sequence: Synthetic oligonucleotide
  Target: FXN; (+) strand; PAM type: YTN; PAM sequence: CTG
attctgaaagcaaagctctt

SEQ ID NO: 35317 - DNA, 20 bp, Artificial Sequence
  Description of Artificial Sequence: Synthetic oligonucleotide
  Target: FXN; (+) strand; PAM type: YTN; PAM sequence: TTC
tgaaagcaaagctcttccta

SEQ ID NO: 35318 - DNA, 20 bp, Artificial Sequence
  Description of Artificial Sequence: Synthetic oligonucleotide
  Target: FXN; (+) strand; PAM type: YTN; PAM sequence: CTG
aaagcaaagctcttcctaca

SEQ ID NO: 35319 - DNA, 20 bp, Artificial Sequence
  Description of Artificial Sequence: Synthetic oligonucleotide
  Target: FXN; (+) strand; PAM type: YTN; PAM sequence: CTC
ttcctacacaaactcctatt

SEQ ID NO: 35320 - DNA, 20 bp, Artificial Sequence
  Description of Artificial Sequence: Synthetic oligonucleotide
  Target: FXN; (+) strand; PAM type: YTN; PAM sequence: CTT
cctacacaaactcctatttc

SEQ ID NO: 35321 - DNA, 20 bp, Artificial Sequence
  Description of Artificial Sequence: Synthetic oligonucleotide
  Target: FXN; (+) strand; PAM type: YTN; PAM sequence: TTC
ctacacaaactcctatttct

SEQ ID NO: 35322 - DNA, 20 bp, Artificial Sequence
  Description of Artificial Sequence: Synthetic oligonucleotide
  Target: FXN; (+) strand; PAM type: YTN; PAM sequence: CTA
cacaaactcctatttctaaa

SEQ ID NO: 35323 - DNA, 20 bp, Artificial Sequence
  Description of Artificial Sequence: Synthetic oligonucleotide
  Target: FXN; (+) strand; PAM type: YTN; PAM sequence: CTC
ctatttctaaatactaaaag

SEQ ID NO: 35324 - DNA, 20 bp, Artificial Sequence
  Description of Artificial Sequence: Synthetic oligonucleotide
  Target: FXN; (+) strand; PAM type: YTN; PAM sequence: CTA
tttctaaatactaaaagaca

SEQ ID NO: 35325 - DNA, 20 bp, Artificial Sequence
  Description of Artificial Sequence: Synthetic oligonucleotide
  Target: FXN; (+) strand; PAM type: YTN; PAM sequence: TTT
ctaaatactaaaagacattt

SEQ ID NO: 35326 - DNA, 20 bp, Artificial Sequence
  Description of Artificial Sequence: Synthetic oligonucleotide
  Target: FXN; (+) strand; PAM type: YTN; PAM sequence: TTC
taaatactaaaagacatttc

SEQ ID NO: 35327 - DNA, 20 bp, Artificial Sequence
  Description of Artificial Sequence: Synthetic oligonucleotide
  Target: FXN; (+) strand; PAM type: YTN; PAM sequence: CTA
aatactaaaagacatttctt

SEQ ID NO: 35328 - DNA, 20 bp, Artificial Sequence
  Description of Artificial Sequence: Synthetic oligonucleotide
  Target: FXN; (+) strand; PAM type: YTN; PAM sequence: CTA
aaagacatttctttatggtg

SEQ ID NO: 35329 - DNA, 20 bp, Artificial Sequence
  Description of Artificial Sequence: Synthetic oligonucleotide
  Target: FXN; (+) strand; PAM type: YTN; PAM sequence: TTT
ctttatggtgtattttgtgt

SEQ ID NO: 35330 - DNA, 20 bp, Artificial Sequence
  Description of Artificial Sequence: Synthetic oligonucleotide
  Target: FXN; (+) strand; PAM type: YTN; PAM sequence: TTC
tttatggtgtattttgtgta

SEQ ID NO: 35331 - DNA, 20 bp, Artificial Sequence
  Description of Artificial Sequence: Synthetic oligonucleotide
  Target: FXN; (+) strand; PAM type: YTN; PAM sequence: CTT
tatggtgtattttgtgtact

SEQ ID NO: 35332 - DNA, 20 bp, Artificial Sequence
  Description of Artificial Sequence: Synthetic oligonucleotide
  Target: FXN; (+) strand; PAM type: YTN; PAM sequence: TTT
atggtgtattttgtgtactt

SEQ ID NO: 35333 - DNA, 20 bp, Artificial Sequence
  Description of Artificial Sequence: Synthetic oligonucleotide
  Target: FXN; (+) strand; PAM type: YTN; PAM sequence: TTA
tggtgtattttgtgtacttg

SEQ ID NO: 35334 - DNA, 20 bp, Artificial Sequence
  Description of Artificial Sequence: Synthetic oligonucleotide
  Target: FXN; (+) strand; PAM type: YTN; PAM sequence: TTT
tgtgtacttgtagaaatgga

SEQ ID NO: 35335 - DNA, 20 bp, Artificial Sequence
  Description of Artificial Sequence: Synthetic oligonucleotide
  Target: FXN; (+) strand; PAM type: YTN; PAM sequence: TTT
gtgtacttgtagaaatggaa

SEQ ID NO: 35336 - DNA, 20 bp, Artificial Sequence
  Description of Artificial Sequence: Synthetic oligonucleotide
  Target: FXN; (+) strand; PAM type: YTN; PAM sequence: TTG
tgtacttgtagaaatggaaa

SEQ ID NO: 35337 - DNA, 20 bp, Artificial Sequence
  Description of Artificial Sequence: Synthetic oligonucleotide
  Target: FXN; (+) strand; PAM type: YTN; PAM sequence: CTT
gtagaaatggaaagtgttga

SEQ ID NO: 35338 - DNA, 20 bp, Artificial Sequence
  Description of Artificial Sequence: Synthetic oligonucleotide
  Target: FXN; (+) strand; PAM type: YTN; PAM sequence: TTG
tagaaatggaaagtgttgag

SEQ ID NO: 35339 - DNA, 20 bp, Artificial Sequence
  Description of Artificial Sequence: Synthetic oligonucleotide
  Target: FXN; (+) strand; PAM type: YTN; PAM sequence: TTG
agataaaacatgaagcaatg

SEQ ID NO: 35340 - DNA, 20 bp, Artificial Sequence
  Description of Artificial Sequence: Synthetic oligonucleotide
  Target: FXN; (+) strand; PAM type: YTN; PAM sequence: CTA
actttttcttgttttaattt

SEQ ID NO: 35341 - DNA, 20 bp, Artificial Sequence
  Description of Artificial Sequence: Synthetic oligonucleotide
  Target: FXN; (+) strand; PAM type: YTN; PAM sequence: CTT
tttcttgttttaatttcttt

SEQ ID NO: 35342 - DNA, 20 bp, Artificial Sequence
  Description of Artificial Sequence: Synthetic oligonucleotide
  Target: FXN; (+) strand; PAM type: YTN; PAM sequence: TTT
ttcttgttttaatttcttta

SEQ ID NO: 35343 - DNA, 20 bp, Artificial Sequence
  Description of Artificial Sequence: Synthetic oligonucleotide
  Target: FXN; (+) strand; PAM type: YTN; PAM sequence: TTT
tcttgttttaatttctttat

SEQ ID NO: 35344 - DNA, 20 bp, Artificial Sequence
  Description of Artificial Sequence: Synthetic oligonucleotide
  Target: FXN; (+) strand; PAM type: YTN; PAM sequence: TTT
cttgttttaatttctttatg

SEQ ID NO: 35345 - DNA, 20 bp, Artificial Sequence
  Description of Artificial Sequence: Synthetic oligonucleotide
  Target: FXN; (+) strand; PAM type: YTN; PAM sequence: TTC
ttgttttaatttctttatgc

SEQ ID NO: 35346 - DNA, 20 bp, Artificial Sequence
  Description of Artificial Sequence: Synthetic oligonucleotide
  Target: FXN; (+) strand; PAM type: YTN; PAM sequence: CTT
gttttaatttctttatgctt

SEQ ID NO: 35347 - DNA, 20 bp, Artificial Sequence
  Description of Artificial Sequence: Synthetic oligonucleotide
  Target: FXN; (+) strand; PAM type: YTN; PAM sequence: TTG
ttttaatttctttatgcttt

SEQ ID NO: 35348 - DNA, 20 bp, Artificial Sequence
  Description of Artificial Sequence: Synthetic oligonucleotide
  Target: FXN; (+) strand; PAM type: YTN; PAM sequence: TTT
taatttctttatgctttttt

SEQ ID NO: 35349 - DNA, 20 bp, Artificial Sequence
  Description of Artificial Sequence: Synthetic oligonucleotide
  Target: FXN; (+) strand; PAM type: YTN; PAM sequence: TTT
aatttctttatgcttttttt

SEQ ID NO: 35350 - DNA, 20 bp, Artificial Sequence
  Description of Artificial Sequence: Synthetic oligonucleotide
  Target: FXN; (+) strand; PAM type: YTN; PAM sequence: TTA
atttctttatgctttttttc

SEQ ID NO: 35351 - DNA, 20 bp, Artificial Sequence
  Description of Artificial Sequence: Synthetic oligonucleotide
  Target: FXN; (+) strand; PAM type: YTN; PAM sequence: TTT
ctttatgctttttttccacc

SEQ ID NO: 35352 - DNA, 20 bp, Artificial Sequence
  Description of Artificial Sequence: Synthetic oligonucleotide
  Target: FXN; (+) strand; PAM type: YTN; PAM sequence: TTC
tttatgctttttttccacct

SEQ ID NO: 35353 - DNA, 20 bp, Artificial Sequence
  Description of Artificial Sequence: Synthetic oligonucleotide
  Target: FXN; (+) strand; PAM type: YTN; PAM sequence: CTT
tatgctttttttccacctaa

SEQ ID NO: 35354 - DNA, 20 bp, Artificial Sequence
  Description of Artificial Sequence: Synthetic oligonucleotide
  Target: FXN; (+) strand; PAM type: YTN; PAM sequence: TTT
atgctttttttccacctaat

SEQ ID NO: 35355 - DNA, 20 bp, Artificial Sequence
  Description of Artificial Sequence: Synthetic oligonucleotide
  Target: FXN; (+) strand; PAM type: YTN; PAM sequence: TTA
tgctttttttccacctaatc

SEQ ID NO: 35356 - DNA, 20 bp, Artificial Sequence
  Description of Artificial Sequence: Synthetic oligonucleotide
  Target: FXN; (+) strand; PAM type: YTN; PAM sequence: CTT
tttttccacctaatccccta

SEQ ID NO: 35357 - DNA, 20 bp, Artificial Sequence
  Description of Artificial Sequence: Synthetic oligonucleotide
  Target: FXN; (+) strand; PAM type: YTN; PAM sequence: TTT
ttttccacctaatcccctag

SEQ ID NO: 35358 - DNA, 20 bp, Artificial Sequence
  Description of Artificial Sequence: Synthetic oligonucleotide
  Target: FXN; (+) strand; PAM type: YTN; PAM sequence: TTT
tttccacctaatcccctaga

SEQ ID NO: 35359 - DNA, 20 bp, Artificial Sequence
  Description of Artificial Sequence: Synthetic oligonucleotide
  Target: FXN; (+) strand; PAM type: YTN; PAM sequence: TTT
ttccacctaatcccctagag

SEQ ID NO: 35360 - DNA, 20 bp, Artificial Sequence
  Description of Artificial Sequence: Synthetic oligonucleotide
  Target: FXN; (+) strand; PAM type: YTN; PAM sequence: TTT
tccacctaatcccctagagt

SEQ ID NO: 35361 - DNA, 20 bp, Artificial Sequence
  Description of Artificial Sequence: Synthetic oligonucleotide
  Target: FXN; (+) strand; PAM type: YTN; PAM sequence: TTT
ccacctaatcccctagagtg

SEQ ID NO: 35362 - DNA, 20 bp, Artificial Sequence
  Description of Artificial Sequence: Synthetic oligonucleotide
  Target: FXN; (+) strand; PAM type: YTN; PAM sequence: TTC
cacctaatcccctagagtgg

SEQ ID NO: 35363 - DNA, 20 bp, Artificial Sequence
  Description of Artificial Sequence: Synthetic oligonucleotide
  Target: FXN; (+) strand; PAM type: YTN; PAM sequence: CTA
atcccctagagtggtgtctt

SEQ ID NO: 35364 - DNA, 20 bp, Artificial Sequence
  Description of Artificial Sequence: Synthetic oligonucleotide
  Target: FXN; (+) strand; PAM type: YTN; PAM sequence: CTA
gagtggtgtcttaactgtca

SEQ ID NO: 35365 - DNA, 20 bp, Artificial Sequence
  Description of Artificial Sequence: Synthetic oligonucleotide
  Target: FXN; (+) strand; PAM type: YTN; PAM sequence: CTT
aactgtcaaactgggtggag

SEQ ID NO: 35366 - DNA, 20 bp, Artificial Sequence
  Description of Artificial Sequence: Synthetic oligonucleotide
  Target: FXN; (+) strand; PAM type: YTN; PAM sequence: TTA
actgtcaaactgggtggaga

SEQ ID NO: 35367 - DNA, 20 bp, Artificial Sequence
  Description of Artificial Sequence: Synthetic oligonucleotide
  Target: FXN; (+) strand; PAM type: YTN; PAM sequence: CTG
tcaaactgggtggagatcta

SEQ ID NO: 35368 - DNA, 20 bp, Artificial Sequence
  Description of Artificial Sequence: Synthetic oligonucleotide
  Target: FXN; (+) strand; PAM type: YTN; PAM sequence: CTG
ggtggagatctaggaaccta

SEQ ID NO: 35369 - DNA, 20 bp, Artificial Sequence
  Description of Artificial Sequence: Synthetic oligonucleotide
  Target: FXN; (+) strand; PAM type: YTN; PAM sequence: CTA
ggaacctatgtgatcaacaa

SEQ ID NO: 35370 - DNA, 20 bp, Artificial Sequence
  Description of Artificial Sequence: Synthetic oligonucleotide
  Target: FXN; (+) strand; PAM type: YTN; PAM sequence: CTA
tgtgatcaacaagcagacgc

SEQ ID NO: 35371 - DNA, 20 bp, Artificial Sequence
  Description of Artificial Sequence: Synthetic oligonucleotide
  Target: FXN; (+) strand; PAM type: YTN; PAM sequence: CTG
gctatcttctccatccaggt

SEQ ID NO: 35372 - DNA, 20 bp, Artificial Sequence
  Description of Artificial Sequence: Synthetic oligonucleotide
  Target: FXN; (+) strand; PAM type: YTN; PAM sequence: CTA
tcttctccatccaggtatgt

SEQ ID NO: 35373 - DNA, 20 bp, Artificial Sequence
  Description of Artificial Sequence: Synthetic oligonucleotide
  Target: FXN; (+) strand; PAM type: YTN; PAM sequence: CTT
ctccatccaggtatgtaggt

SEQ ID NO: 35374 - DNA, 20 bp, Artificial Sequence
  Description of Artificial Sequence: Synthetic oligonucleotide
  Target: FXN; (+) strand; PAM type: YTN; PAM sequence: TTC
tccatccaggtatgtaggta

SEQ ID NO: 35375 - DNA, 20 bp, Artificial Sequence
  Description of Artificial Sequence: Synthetic oligonucleotide
  Target: FXN; (+) strand; PAM type: YTN; PAM sequence: CTC
catccaggtatgtaggtatg

SEQ ID NO: 35376 - DNA, 20 bp, Artificial Sequence
  Description of Artificial Sequence: Synthetic oligonucleotide
  Target: FXN; (+) strand; PAM type: YTN; PAM sequence: TTC
agaagtcaacatatgtaatt

SEQ ID NO: 35377 - DNA, 20 bp, Artificial Sequence
  Description of Artificial Sequence: Synthetic oligonucleotide
  Target: FXN; (+) strand; PAM type: YTN; PAM sequence: TTC
ttaaagacttccgaaatgtg

SEQ ID NO: 35378 - DNA, 20 bp, Artificial Sequence
  Description of Artificial Sequence: Synthetic oligonucleotide
  Target: FXN; (+) strand; PAM type: YTN; PAM sequence: CTT
aaagacttccgaaatgtgac

SEQ ID NO: 35379 - DNA, 20 bp, Artificial Sequence
  Description of Artificial Sequence: Synthetic oligonucleotide
  Target: FXN; (+) strand; PAM type: YTN; PAM sequence: TTA
aagacttccgaaatgtgaca

SEQ ID NO: 35380 - DNA, 20 bp, Artificial Sequence
  Description of Artificial Sequence: Synthetic oligonucleotide
  Target: FXN; (+) strand; PAM type: YTN; PAM sequence: CTT
ccgaaatgtgacattgtgga

SEQ ID NO: 35381 - DNA, 20 bp, Artificial Sequence
  Description of Artificial Sequence: Synthetic oligonucleotide
  Target: FXN; (+) strand; PAM type: YTN; PAM sequence: TTC
cgaaatgtgacattgtggac

SEQ ID NO: 35382 - DNA, 20 bp, Artificial Sequence
  Description of Artificial Sequence: Synthetic oligonucleotide
  Target: FXN; (+) strand; PAM type: YTN; PAM sequence: TTG
tggaccatttaagaaatgtc

SEQ ID NO: 35383 - DNA, 20 bp, Artificial Sequence
  Description of Artificial Sequence: Synthetic oligonucleotide
  Target: FXN; (+) strand; PAM type: YTN; PAM sequence: TTT
aagaaatgtcggctgagcac

SEQ ID NO: 35384 - DNA, 20 bp, Artificial Sequence
  Description of Artificial Sequence: Synthetic oligonucleotide
  Target: FXN; (+) strand; PAM type: YTN; PAM sequence: TTA
agaaatgtcggctgagcaca

SEQ ID NO: 35385 - DNA, 20 bp, Artificial Sequence
  Description of Artificial Sequence: Synthetic oligonucleotide
  Target: FXN; (+) strand; PAM type: YTN; PAM sequence: CTG
agcacagtggctgacacctg

SEQ ID NO: 35386 - DNA, 20 bp, Artificial Sequence
  Description of Artificial Sequence: Synthetic oligonucleotide
  Target: FXN; (+) strand; PAM type: YTN; PAM sequence: CTG
acacctgtaatcccaacact

SEQ ID NO: 35387 - DNA, 20 bp, Artificial Sequence
  Description of Artificial Sequence: Synthetic oligonucleotide
  Target: FXN; (+) strand; PAM type: YTN; PAM sequence: CTG
taatcccaacactttgagag

SEQ ID NO: 35388 - DNA, 20 bp, Artificial Sequence
  Description of Artificial Sequence: Synthetic oligonucleotide
  Target: FXN; (+) strand; PAM type: YTN; PAM sequence: CTT
tgagaggctgaggtaggagg

SEQ ID NO: 35389 - DNA, 20 bp, Artificial Sequence
  Description of Artificial Sequence: Synthetic oligonucleotide
  Target: FXN; (+) strand; PAM type: YTN; PAM sequence: TTT
gagaggctgaggtaggagga

SEQ ID NO: 35390 - DNA, 20 bp, Artificial Sequence
  Description of Artificial Sequence: Synthetic oligonucleotide
  Target: FXN; (+) strand; PAM type: YTN; PAM sequence: TTG
agaggctgaggtaggaggat

SEQ ID NO: 35391 - DNA, 20 bp, Artificial Sequence
  Description of Artificial Sequence: Synthetic oligonucleotide
  Target: FXN; (+) strand; PAM type: YTN; PAM sequence: CTG
aggtaggaggatcacttgag

SEQ ID NO: 35392 - DNA, 20 bp, Artificial Sequence
  Description of Artificial Sequence: Synthetic oligonucleotide
  Target: FXN; (+) strand; PAM type: YTN; PAM sequence: CTT
gaggacaggagttcagaacc

SEQ ID NO: 35393 - DNA, 20 bp, Artificial Sequence
  Description of Artificial Sequence: Synthetic oligonucleotide
  Target: FXN; (+) strand; PAM type: YTN; PAM sequence: TTG
aggacaggagttcagaacca

SEQ ID NO: 35394 - DNA, 20 bp, Artificial Sequence
  Description of Artificial Sequence: Synthetic oligonucleotide
  Target: FXN; (+) strand; PAM type: YTN; PAM sequence: TTC
agaaccatcctgggcaacat

SEQ ID NO: 35395 - DNA, 20 bp, Artificial Sequence
  Description of Artificial Sequence: Synthetic oligonucleotide
  Target: FXN; (+) strand; PAM type: YTN; PAM sequence: CTG
ggcaacatagtgagtccctg

SEQ ID NO: 35396 - DNA, 20 bp, Artificial Sequence
  Description of Artificial Sequence: Synthetic oligonucleotide
  Target: FXN; (+) strand; PAM type: YTN; PAM sequence: CTG
tctctgtaaagaaaataaaa

SEQ ID NO: 35397 - DNA, 20 bp, Artificial Sequence
  Description of Artificial Sequence: Synthetic oligonucleotide
  Target: FXN; (+) strand; PAM type: YTN; PAM sequence: CTC
tgtaaagaaaataaaaataa

SEQ ID NO: 35398 - DNA, 20 bp, Artificial Sequence
  Description of Artificial Sequence: Synthetic oligonucleotide
  Target: FXN; (+) strand; PAM type: YTN; PAM sequence: CTG
taaagaaaataaaaataaag

SEQ ID NO: 35399 - DNA, 20 bp, Artificial Sequence
  Description of Artificial Sequence: Synthetic oligonucleotide
  Target: FXN; (+) strand; PAM type: YTN; PAM sequence: CTG
ggtgcaggcttacacctgta

SEQ ID NO: 35400 - DNA, 20 bp, Artificial Sequence
  Description of Artificial Sequence: Synthetic oligonucleotide
  Target: FXN; (+) strand; PAM type: YTN; PAM sequence: CTT
acacctgtaatcccagcact

SEQ ID NO: 35401 - DNA, 20 bp, Artificial Sequence
  Description of Artificial Sequence: Synthetic oligonucleotide
  Target: FXN; (+) strand; PAM type: YTN; PAM sequence: TTA
cacctgtaatcccagcactt

SEQ ID NO: 35402 - DNA, 20 bp, Artificial Sequence
  Description of Artificial Sequence: Synthetic oligonucleotide
  Target: FXN; (+) strand; PAM type: YTN; PAM sequence: CTG
taatcccagcactttgggag

SEQ ID NO: 35403 - DNA, 20 bp, Artificial Sequence
  Description of Artificial Sequence: Synthetic oligonucleotide
  Target: FXN; (+) strand; PAM type: YTN; PAM sequence: CTT
tgggaggccaaggcctgtgg

SEQ ID NO: 35404 - DNA, 20 bp, Artificial Sequence
  Description of Artificial Sequence: Synthetic oligonucleotide
  Target: FXN; (+) strand; PAM type: YTN; PAM sequence: TTT
gggaggccaaggcctgtgga

SEQ ID NO: 35405 - DNA, 20 bp, Artificial Sequence
  Description of Artificial Sequence: Synthetic oligonucleotide
  Target: FXN; (+) strand; PAM type: YTN; PAM sequence: TTG
ggaggccaaggcctgtggat

SEQ ID NO: 35406 - DNA, 20 bp, Artificial Sequence
  Description of Artificial Sequence: Synthetic oligonucleotide
  Target: FXN; (+) strand; PAM type: YTN; PAM sequence: CTG
tggatcacttgagctcagga

SEQ ID NO: 35407 - DNA, 20 bp, Artificial Sequence
  Description of Artificial Sequence: Synthetic oligonucleotide
  Target: FXN; (+) strand; PAM type: YTN; PAM sequence: CTT
gagctcaggagtttgagacc

SEQ ID NO: 35408 - DNA, 20 bp, Artificial Sequence
  Description of Artificial Sequence: Synthetic oligonucleotide
  Target: FXN; (+) strand; PAM type: YTN; PAM sequence: TTG
agctcaggagtttgagacca

SEQ ID NO: 35409 - DNA, 20 bp, Artificial Sequence
  Description of Artificial Sequence: Synthetic oligonucleotide
  Target: FXN; (+) strand; PAM type: YTN; PAM sequence: CTC
aggagtttgagaccagcctg

SEQ ID NO: 35410 - DNA, 20 bp, Artificial Sequence
  Description of Artificial Sequence: Synthetic oligonucleotide
  Target: FXN; (+) strand; PAM type: YTN; PAM sequence: TTT
gagaccagcctgggcaatgt

SEQ ID NO: 35411 - DNA, 20 bp, Artificial Sequence
  Description of Artificial Sequence: Synthetic oligonucleotide
  Target: FXN; (+) strand; PAM type: YTN; PAM sequence: TTG
agaccagcctgggcaatgtc

SEQ ID NO: 35412 - DNA, 20 bp, Artificial Sequence
  Description of Artificial Sequence: Synthetic oligonucleotide
  Target: FXN; (+) strand; PAM type: YTN; PAM sequence: CTG
ggcaatgtcacaaagcccca

SEQ ID NO: 35413 - DNA, 20 bp, Artificial Sequence
  Description of Artificial Sequence: Synthetic oligonucleotide
  Target: FXN; (+) strand; PAM type: YTN; PAM sequence: CTC
tactaaaaatataaaaatta

SEQ ID NO: 35414 - DNA, 20 bp, Artificial Sequence
  Description of Artificial Sequence: Synthetic oligonucleotide
  Target: FXN; (+) strand; PAM type: YTN; PAM sequence: CTA
ctaaaaatataaaaattagc

SEQ ID NO: 35415 - DNA, 20 bp, Artificial Sequence
  Description of Artificial Sequence: Synthetic oligonucleotide
  Target: FXN; (+) strand; PAM type: YTN; PAM sequence: CTA
aaaatataaaaattagccag

SEQ ID NO: 35416 - DNA, 20 bp, Artificial Sequence
  Description of Artificial Sequence: Synthetic oligonucleotide
  Target: FXN; (+) strand; PAM type: YTN; PAM sequence: TTA
gccaggtgtggtggcacacg

SEQ ID NO: 35417 - DNA, 20 bp, Artificial Sequence
  Description of Artificial Sequence: Synthetic oligonucleotide
  Target: FXN; (+) strand; PAM type: YTN; PAM sequence: CTA
tagtcccaactacttggaag

SEQ ID NO: 35418 - DNA, 20 bp, Artificial Sequence
  Description of Artificial Sequence: Synthetic oligonucleotide
  Target: FXN; (+) strand; PAM type: YTN; PAM sequence: CTA
cttggaaggctgaggttgag

SEQ ID NO: 35419 - DNA, 20 bp, Artificial Sequence
  Description of Artificial Sequence: Synthetic oligonucleotide
  Target: FXN; (+) strand; PAM type: YTN; PAM sequence: CTT
ggaaggctgaggttgagcct

SEQ ID NO: 35420 - DNA, 20 bp, Artificial Sequence
  Description of Artificial Sequence: Synthetic oligonucleotide
  Target: FXN; (+) strand; PAM type: YTN; PAM sequence: TTG
gaaggctgaggttgagcctc

SEQ ID NO: 35421 - DNA, 20 bp, Artificial Sequence
  Description of Artificial Sequence: Synthetic oligonucleotide
  Target: FXN; (+) strand; PAM type: YTN; PAM sequence: CTG
aggttgagcctcagcctgag

SEQ ID NO: 35422 - DNA, 20 bp, Artificial Sequence
  Description of Artificial Sequence: Synthetic oligonucleotide
  Target: FXN; (+) strand; PAM type: YTN; PAM sequence: TTG
agcctcagcctgagcccagg

SEQ ID NO: 35423 - DNA, 20 bp, Artificial Sequence
  Description of Artificial Sequence: Synthetic oligonucleotide
  Target: FXN; (+) strand; PAM type: YTN; PAM sequence: CTC
agcctgagcccaggaggtgg

SEQ ID NO: 35424 - DNA, 20 bp, Artificial Sequence
  Description of Artificial Sequence: Synthetic oligonucleotide
  Target: FXN; (+) strand; PAM type: YTN; PAM sequence: CTG
agcccaggaggtggaggttg

SEQ ID NO: 35425 - DNA, 20 bp, Artificial Sequence
  Description of Artificial Sequence: Synthetic oligonucleotide
  Target: FXN; (+) strand; PAM type: YTN; PAM sequence: TTG
cagtgagccaagatcgcgcc

SEQ ID NO: 35426 - DNA, 20 bp, Artificial Sequence
  Description of Artificial Sequence: Synthetic oligonucleotide
  Target: FXN; (+) strand; PAM type: YTN; PAM sequence: CTG
cactccagcctgggcaacag

SEQ ID NO: 35427 - DNA, 20 bp, Artificial Sequence
  Description of Artificial Sequence: Synthetic oligonucleotide
  Target: FXN; (+) strand; PAM type: YTN; PAM sequence: CTC
cagcctgggcaacagggcca

SEQ ID NO: 35428 - DNA, 20 bp, Artificial Sequence
  Description of Artificial Sequence: Synthetic oligonucleotide
  Target: FXN; (+) strand; PAM type: YTN; PAM sequence: CTG
ggcaacagggccagaccctg

SEQ ID NO: 35429 - DNA, 20 bp, Artificial Sequence
  Description of Artificial Sequence: Synthetic oligonucleotide
  Target: FXN; (+) strand; PAM type: YTN; PAM sequence: CTG
tcccaaaaaaaaaaaaaaag

SEQ ID NO: 35430 - DNA, 20 bp, Artificial Sequence
  Description of Artificial Sequence: Synthetic oligonucleotide
  Target: FXN; (+) strand; PAM type: YTN; PAM sequence: CTT
atgttagcatccttgtaagt

SEQ ID NO: 35431 - DNA, 20 bp, Artificial Sequence
  Description of Artificial Sequence: Synthetic oligonucleotide
  Target: FXN; (+) strand; PAM type: YTN; PAM sequence: TTA
tgttagcatccttgtaagtg

SEQ ID NO: 35432 - DNA, 20 bp, Artificial Sequence
  Description of Artificial Sequence: Synthetic oligonucleotide
  Target: FXN; (+) strand; PAM type: YTN; PAM sequence: TTA
gcatccttgtaagtgagcct

SEQ ID NO: 35433 - DNA, 20 bp, Artificial Sequence
  Description of Artificial Sequence: Synthetic oligonucleotide
  Target: FXN; (+) strand; PAM type: YTN; PAM sequence: CTT
gtaagtgagcctttcctgat

SEQ ID NO: 35434 - DNA, 20 bp, Artificial Sequence
  Description of Artificial Sequence: Synthetic oligonucleotide
  Target: FXN; (+) strand; PAM type: YTN; PAM sequence: TTG
taagtgagcctttcctgata

SEQ ID NO: 35435 - DNA, 20 bp, Artificial Sequence
  Description of Artificial Sequence: Synthetic oligonucleotide
  Target: FXN; (+) strand; PAM type: YTN; PAM sequence: CTT
tcctgatattttgcagcctg

SEQ ID NO: 35436 - DNA, 20 bp, Artificial Sequence
  Description of Artificial Sequence: Synthetic oligonucleotide
  Target: FXN; (+) strand; PAM type: YTN; PAM sequence: TTT
cctgatattttgcagcctgt

SEQ ID NO: 35437 - DNA, 20 bp, Artificial Sequence
  Description of Artificial Sequence: Synthetic oligonucleotide
  Target: FXN; (+) strand; PAM type: YTN; PAM sequence: TTC
ctgatattttgcagcctgtc

SEQ ID NO: 35438 - DNA, 20 bp, Artificial Sequence
  Description of Artificial Sequence: Synthetic oligonucleotide
  Target: FXN; (+) strand; PAM type: YTN; PAM sequence: CTG
atattttgcagcctgtctca

SEQ ID NO: 35439 - DNA, 20 bp, Artificial Sequence
  Description of Artificial Sequence: Synthetic oligonucleotide
  Target: FXN; (+) strand; PAM type: YTN; PAM sequence: TTT
tgcagcctgtctcattctca

SEQ ID NO: 35440 - DNA, 20 bp, Artificial Sequence
  Description of Artificial Sequence: Synthetic oligonucleotide
  Target: FXN; (+) strand; PAM type: YTN; PAM sequence: TTT
gcagcctgtctcattctcag

SEQ ID NO: 35441 - DNA, 20 bp, Artificial Sequence
  Description of Artificial Sequence: Synthetic oligonucleotide
  Target: FXN; (+) strand; PAM type: YTN; PAM sequence: TTG
cagcctgtctcattctcagt

SEQ ID NO: 35442 - DNA, 20 bp, Artificial Sequence
  Description of Artificial Sequence: Synthetic oligonucleotide
  Target: FXN; (+) strand; PAM type: YTN; PAM sequence: CTG
tctcattctcagtagaaaag

SEQ ID NO: 35443 - DNA, 20 bp, Artificial Sequence
  Description of Artificial Sequence: Synthetic oligonucleotide
  Target: FXN; (+) strand; PAM type: YTN; PAM sequence: CTC
attctcagtagaaaagttta

SEQ ID NO: 35444 - DNA, 20 bp, Artificial Sequence
  Description of Artificial Sequence: Synthetic oligonucleotide
  Target: FXN; (+) strand; PAM type: YTN; PAM sequence: TTC
tcagtagaaaagtttactct

SEQ ID NO: 35445 - DNA, 20 bp, Artificial Sequence
  Description of Artificial Sequence: Synthetic oligonucleotide
  Target: FXN; (+) strand; PAM type: YTN; PAM sequence: CTC
agtagaaaagtttactctag

SEQ ID NO: 35446 - DNA, 20 bp, Artificial Sequence
  Description of Artificial Sequence: Synthetic oligonucleotide
  Target: FXN; (+) strand; PAM type: YTN; PAM sequence: TTT
actctagttacataacttct

SEQ ID NO: 35447 - DNA, 20 bp, Artificial Sequence
  Description of Artificial Sequence: Synthetic oligonucleotide
  Target: FXN; (+) strand; PAM type: YTN; PAM sequence: TTA
ctctagttacataacttctc

SEQ ID NO: 35448 - DNA, 20 bp, Artificial Sequence
  Description of Artificial Sequence: Synthetic oligonucleotide
  Target: FXN; (+) strand; PAM type: YTN; PAM sequence: CTC
tagttacataacttctccct

SEQ ID NO: 35449 - DNA, 20 bp, Artificial Sequence
  Description of Artificial Sequence: Synthetic oligonucleotide
  Target: FXN; (+) strand; PAM type: YTN; PAM sequence: CTA
gttacataacttctccctgc

SEQ ID NO: 35450 - DNA, 20 bp, Artificial Sequence
  Description of Artificial Sequence: Synthetic oligonucleotide
  Target: FXN; (+) strand; PAM type: YTN; PAM sequence: TTA
cataacttctccctgctgac

SEQ ID NO: 35451 - DNA, 20 bp, Artificial Sequence
  Description of Artificial Sequence: Synthetic oligonucleotide
  Target: FXN; (+) strand; PAM type: YTN; PAM sequence: CTT
ctccctgctgacaatttgga

SEQ ID NO: 35452 - DNA, 20 bp, Artificial Sequence
  Description of Artificial Sequence: Synthetic oligonucleotide
  Target: FXN; (+) strand; PAM type: YTN; PAM sequence: TTC
tccctgctgacaatttggat

SEQ ID NO: 35453 - DNA, 20 bp, Artificial Sequence
  Description of Artificial Sequence: Synthetic oligonucleotide
  Target: FXN; (+) strand; PAM type: YTN; PAM sequence: CTC
cctgctgacaatttggatac

SEQ ID NO: 35454 - DNA, 20 bp, Artificial Sequence
  Description of Artificial Sequence: Synthetic oligonucleotide
  Target: FXN; (+) strand; PAM type: YTN; PAM sequence: CTG
ctgacaatttggatactgta

SEQ ID NO: 35455 - DNA, 20 bp, Artificial Sequence
  Description of Artificial Sequence: Synthetic oligonucleotide
  Target: FXN; (+) strand; PAM type: YTN; PAM sequence: CTG
acaatttggatactgtaagc

SEQ ID NO: 35456 - DNA, 20 bp, Artificial Sequence
  Description of Artificial Sequence: Synthetic oligonucleotide
  Target: FXN; (+) strand; PAM type: YTN; PAM sequence: TTT
ggatactgtaagcaggcatc

SEQ ID NO: 35457 - DNA, 20 bp, Artificial Sequence
  Description of Artificial Sequence: Synthetic oligonucleotide
  Target: FXN; (+) strand; PAM type: YTN; PAM sequence: TTG
gatactgtaagcaggcatca

SEQ ID NO: 35458 - DNA, 20 bp, Artificial Sequence
  Description of Artificial Sequence: Synthetic oligonucleotide
  Target: FXN; (+) strand; PAM type: YTN; PAM sequence: CTG
taagcaggcatcaggatatt

SEQ ID NO: 35459 - DNA, 20 bp, Artificial Sequence
  Description of Artificial Sequence: Synthetic oligonucleotide
  Target: FXN; (+) strand; PAM type: YTN; PAM sequence: TTA
agatctgaagtgagtagctt

SEQ ID NO: 35460 - DNA, 20 bp, Artificial Sequence
  Description of Artificial Sequence: Synthetic oligonucleotide
  Target: FXN; (+) strand; PAM type: YTN; PAM sequence: CTG
aagtgagtagcttataactt

SEQ ID NO: 35461 - DNA, 20 bp, Artificial Sequence
  Description of Artificial Sequence: Synthetic oligonucleotide
  Target: FXN; (+) strand; PAM type: YTN; PAM sequence: CTT
ataacttttccaaatccagc

SEQ ID NO: 35462 - DNA, 20 bp, Artificial Sequence
  Description of Artificial Sequence: Synthetic oligonucleotide
  Target: FXN; (+) strand; PAM type: YTN; PAM sequence: TTA
taacttttccaaatccagcc

SEQ ID NO: 35463 - DNA, 20 bp, Artificial Sequence
  Description of Artificial Sequence: Synthetic oligonucleotide
  Target: FXN; (+) strand; PAM type: YTN; PAM sequence: CTT
ttccaaatccagcctagaca

SEQ ID NO: 35464 - DNA, 20 bp, Artificial Sequence
  Description of Artificial Sequence: Synthetic oligonucleotide
  Target: FXN; (+) strand; PAM type: YTN; PAM sequence: TTT
tccaaatccagcctagacag

SEQ ID NO: 35465 - DNA, 20 bp, Artificial Sequence
  Description of Artificial Sequence: Synthetic oligonucleotide
  Target: FXN; (+) strand; PAM type: YTN; PAM sequence: TTT
ccaaatccagcctagacagt

SEQ ID NO: 35466 - DNA, 20 bp, Artificial Sequence
  Description of Artificial Sequence: Synthetic oligonucleotide
  Target: FXN; (+) strand; PAM type: YTN; PAM sequence: TTC
caaatccagcctagacagtt

SEQ ID NO: 35467 - DNA, 20 bp, Artificial Sequence
  Description of Artificial Sequence: Synthetic oligonucleotide
  Target: FXN; (+) strand; PAM type: YTN; PAM sequence: CTA
gacagttttcctctattaaa

SEQ ID NO: 35468 - DNA, 20 bp, Artificial Sequence
  Description of Artificial Sequence: Synthetic oligonucleotide
  Target: FXN; (+) strand; PAM type: YTN; PAM sequence: TTT
tcctctattaaattattgcc

SEQ ID NO: 35469 - DNA, 20 bp, Artificial Sequence
  Description of Artificial Sequence: Synthetic oligonucleotide
  Target: FXN; (+) strand; PAM type: YTN; PAM sequence: TTT
cctctattaaattattgccc

SEQ ID NO: 35470 - DNA, 20 bp, Artificial Sequence
  Description of Artificial Sequence: Synthetic oligonucleotide
  Target: FXN; (+) strand; PAM type: YTN; PAM sequence: TTC
ctctattaaattattgccct

SEQ ID NO: 35471 - DNA, 20 bp, Artificial Sequence
  Description of Artificial Sequence: Synthetic oligonucleotide
  Target: FXN; (+) strand; PAM type: YTN; PAM sequence: CTC
tattaaattattgccctgac

SEQ ID NO: 35472 - DNA, 20 bp, Artificial Sequence
  Description of Artificial Sequence: Synthetic oligonucleotide
  Target: FXN; (+) strand; PAM type: YTN; PAM sequence: CTA
ttaaattattgccctgactt

SEQ ID NO: 35473 - DNA, 20 bp, Artificial Sequence
  Description of Artificial Sequence: Synthetic oligonucleotide
  Target: FXN; (+) strand; PAM type: YTN; PAM sequence: TTA
aattattgccctgactttaa

SEQ ID NO: 35474 - DNA, 20 bp, Artificial Sequence
  Description of Artificial Sequence: Synthetic oligonucleotide
  Target: FXN; (+) strand; PAM type: YTN; PAM sequence: TTA
ttgccctgactttaaaagaa

SEQ ID NO: 35475 - DNA, 20 bp, Artificial Sequence
  Description of Artificial Sequence: Synthetic oligonucleotide
  Target: FXN; (+) strand; PAM type: YTN; PAM sequence: TTG
ccctgactttaaaagaagct

SEQ ID NO: 35476 - DNA, 20 bp, Artificial Sequence
  Description of Artificial Sequence: Synthetic oligonucleotide
  Target: FXN; (+) strand; PAM type: YTN; PAM sequence: CTG
actttaaaagaagctacttt

SEQ ID NO: 35477 - DNA, 20 bp, Artificial Sequence
  Description of Artificial Sequence: Synthetic oligonucleotide
  Target: FXN; (+) strand; PAM type: YTN; PAM sequence: CTT
taaaagaagctacttttgac

SEQ ID NO: 35478 - DNA, 20 bp, Artificial Sequence
  Description of Artificial Sequence: Synthetic oligonucleotide
  Target: FXN; (+) strand; PAM type: YTN; PAM sequence: TTT
aaaagaagctacttttgacc

SEQ ID NO: 35479 - DNA, 20 bp, Artificial Sequence
  Description of Artificial Sequence: Synthetic oligonucleotide
  Target: FXN; (+) strand; PAM type: YTN; PAM sequence: TTA
aaagaagctacttttgacct

SEQ ID NO: 35480 - DNA, 20 bp, Artificial Sequence
  Description of Artificial Sequence: Synthetic oligonucleotide
  Target: FXN; (+) strand; PAM type: YTN; PAM sequence: CTA
cttttgaccttgtagcgttt

SEQ ID NO: 35481 - DNA, 20 bp, Artificial Sequence
  Description of Artificial Sequence: Synthetic oligonucleotide
  Target: FXN; (+) strand; PAM type: YTN; PAM sequence: CTT
ttgaccttgtagcgtttgaa

SEQ ID NO: 35482 - DNA, 20 bp, Artificial Sequence
  Description of Artificial Sequence: Synthetic oligonucleotide
  Target: FXN; (+) strand; PAM type: YTN; PAM sequence: TTT
tgaccttgtagcgtttgaac

SEQ ID NO: 35483 - DNA, 20 bp, Artificial Sequence
  Description of Artificial Sequence: Synthetic oligonucleotide
  Target: FXN; (+) strand; PAM type: YTN; PAM sequence: TTT
gaccttgtagcgtttgaaca

SEQ ID NO: 35484 - DNA, 20 bp, Artificial Sequence
  Description of Artificial Sequence: Synthetic oligonucleotide
  Target: FXN; (+) strand; PAM type: YTN; PAM sequence: TTG
accttgtagcgtttgaacaa

SEQ ID NO: 35485 - DNA, 20 bp, Artificial Sequence
  Description of Artificial Sequence: Synthetic oligonucleotide
  Target: FXN; (+) strand; PAM type: YTN; PAM sequence: CTT
gtagcgtttgaacaagttgc

SEQ ID NO: 35486 - DNA, 20 bp, Artificial Sequence
  Description of Artificial Sequence: Synthetic oligonucleotide
  Target: FXN; (+) strand; PAM type: YTN; PAM sequence: TTG
tagcgtttgaacaagttgca

SEQ ID NO: 35487 - DNA, 20 bp, Artificial Sequence
  Description of Artificial Sequence: Synthetic oligonucleotide
  Target: FXN; (+) strand; PAM type: YTN; PAM sequence: TTT
gaacaagttgcactttgtct

SEQ ID NO: 35488 - DNA, 20 bp, Artificial Sequence
  Description of Artificial Sequence: Synthetic oligonucleotide
  Target: FXN; (+) strand; PAM type: YTN; PAM sequence: TTG
aacaagttgcactttgtctt

SEQ ID NO: 35489 - DNA, 20 bp, Artificial Sequence
  Description of Artificial Sequence: Synthetic oligonucleotide
  Target: FXN; (+) strand; PAM type: YTN; PAM sequence: TTG
cactttgtcttcaaagcaag

SEQ ID NO: 35490 - DNA, 20 bp, Artificial Sequence
  Description of Artificial Sequence: Synthetic oligonucleotide
  Target: FXN; (+) strand; PAM type: YTN; PAM sequence: CTT
tgtcttcaaagcaagttaaa

SEQ ID NO: 35491 - DNA, 20 bp, Artificial Sequence
  Description of Artificial Sequence: Synthetic oligonucleotide
  Target: FXN; (+) strand; PAM type: YTN; PAM sequence: TTT
gtcttcaaagcaagttaaag

SEQ ID NO: 35492 - DNA, 20 bp, Artificial Sequence
  Description of Artificial Sequence: Synthetic oligonucleotide
  Target: FXN; (+) strand; PAM type: YTN; PAM sequence: TTG
tcttcaaagcaagttaaagt

SEQ ID NO: 35493 - DNA, 20 bp, Artificial Sequence
  Description of Artificial Sequence: Synthetic oligonucleotide
  Target: FXN; (+) strand; PAM type: YTN; PAM sequence: CTT
caaagcaagttaaagtttga

SEQ ID NO: 35494 - DNA, 20 bp, Artificial Sequence
  Description of Artificial Sequence: Synthetic oligonucleotide
  Target: FXN; (+) strand; PAM type: YTN; PAM sequence: TTC
aaagcaagttaaagtttgac

SEQ ID NO: 35495 - DNA, 20 bp, Artificial Sequence
  Description of Artificial Sequence: Synthetic oligonucleotide
  Target: FXN; (+) strand; PAM type: YTN; PAM sequence: TTA
aagtttgacctctacttgtt

SEQ ID NO: 35496 - DNA, 20 bp, Artificial Sequence
  Description of Artificial Sequence: Synthetic oligonucleotide
  Target: FXN; (+) strand; PAM type: YTN; PAM sequence: TTT
gacctctacttgttttgagc

SEQ ID NO: 35497 - DNA, 20 bp, Artificial Sequence
  Description of Artificial Sequence: Synthetic oligonucleotide
  Target: FXN; (+) strand; PAM type: YTN; PAM sequence: TTG
acctctacttgttttgagcc

SEQ ID NO: 35498 - DNA, 20 bp, Artificial Sequence
  Description of Artificial Sequence: Synthetic oligonucleotide
  Target: FXN; (+) strand; PAM type: YTN; PAM sequence: CTC
tacttgttttgagcctctca

SEQ ID NO: 35499 - DNA, 20 bp, Artificial Sequence
  Description of Artificial Sequence: Synthetic oligonucleotide
  Target: FXN; (+) strand; PAM type: YTN; PAM sequence: CTA
cttgttttgagcctctcagg

SEQ ID NO: 35500 - DNA, 20 bp, Artificial Sequence
  Description of Artificial Sequence: Synthetic oligonucleotide
  Target: FXN; (+) strand; PAM type: YTN; PAM sequence: CTT
gttttgagcctctcaggtaa

SEQ ID NO: 35501 - DNA, 20 bp, Artificial Sequence
  Description of Artificial Sequence: Synthetic oligonucleotide
  Target: FXN; (+) strand; PAM type: YTN; PAM sequence: TTG
ttttgagcctctcaggtaaa

SEQ ID NO: 35502 - DNA, 20 bp, Artificial Sequence
  Description of Artificial Sequence: Synthetic oligonucleotide
  Target: FXN; (+) strand; PAM type: YTN; PAM sequence: TTT
tgagcctctcaggtaaaggg

SEQ ID NO: 35503 - DNA, 20 bp, Artificial Sequence
  Description of Artificial Sequence: Synthetic oligonucleotide
  Target: FXN; (+) strand; PAM type: YTN; PAM sequence: TTT
gagcctctcaggtaaagggt

SEQ ID NO: 35504 - DNA, 20 bp, Artificial Sequence
  Description of Artificial Sequence: Synthetic oligonucleotide
  Target: FXN; (+) strand; PAM type: YTN; PAM sequence: TTG
agcctctcaggtaaagggtt

SEQ ID NO: 35505 - DNA, 20 bp, Artificial Sequence
  Description of Artificial Sequence: Synthetic oligonucleotide
  Target: FXN; (+) strand; PAM type: YTN; PAM sequence: CTC
tcaggtaaagggttatttga

SEQ ID NO: 35506 - DNA, 20 bp, Artificial Sequence
  Description of Artificial Sequence: Synthetic oligonucleotide
  Target: FXN; (+) strand; PAM type: YTN; PAM sequence: CTC
aggtaaagggttatttgaat

SEQ ID NO: 35507 - DNA, 20 bp, Artificial Sequence
  Description of Artificial Sequence: Synthetic oligonucleotide
  Target: FXN; (+) strand; PAM type: YTN; PAM sequence: TTA
tttgaattccctttgcaggt

SEQ ID NO: 35508 - DNA, 20 bp, Artificial Sequence
  Description of Artificial Sequence: Synthetic oligonucleotide
  Target: FXN; (+) strand; PAM type: YTN; PAM sequence: TTT
gaattccctttgcaggttgg

SEQ ID NO: 35509 - DNA, 20 bp, Artificial Sequence
  Description of Artificial Sequence: Synthetic oligonucleotide
  Target: FXN; (+) strand; PAM type: YTN; PAM sequence: TTG
aattccctttgcaggttggg

SEQ ID NO: 35510 - DNA, 20 bp, Artificial Sequence
  Description of Artificial Sequence: Synthetic oligonucleotide
  Target: FXN; (+) strand; PAM type: YTN; PAM sequence: TTC
cctttgcaggttggggttgt

SEQ ID NO: 35511 - DNA, 20 bp, Artificial Sequence
  Description of Artificial Sequence: Synthetic oligonucleotide
  Target: FXN; (+) strand; PAM type: YTN; PAM sequence: CTT
tgcaggttggggttgtgtac

SEQ ID NO: 35512 - DNA, 20 bp, Artificial Sequence
  Description of Artificial Sequence: Synthetic oligonucleotide
  Target: FXN; (+) strand; PAM type: YTN; PAM sequence: TTT
gcaggttggggttgtgtacc

SEQ ID NO: 35513 - DNA, 20 bp, Artificial Sequence
  Description of Artificial Sequence: Synthetic oligonucleotide
  Target: FXN; (+) strand; PAM type: YTN; PAM sequence: TTG
caggttggggttgtgtaccc

SEQ ID NO: 35514 - DNA, 20 bp, Artificial Sequence
  Description of Artificial Sequence: Synthetic oligonucleotide
  Target: FXN; (+) strand; PAM type: YTN; PAM sequence: TTG
gggttgtgtaccctgtggag

SEQ ID NO: 35515 - DNA, 20 bp, Artificial Sequence
  Description of Artificial Sequence: Synthetic oligonucleotide
  Target: FXN; (+) strand; PAM type: YTN; PAM sequence: TTG
tgtaccctgtggaggtggta

SEQ ID NO: 35516 - DNA, 20 bp, Artificial Sequence
  Description of Artificial Sequence: Synthetic oligonucleotide
  Target: FXN; (+) strand; PAM type: YTN; PAM sequence: CTG
tggaggtggtagagtgttat

SEQ ID NO: 35517 - DNA, 20 bp, Artificial Sequence
  Description of Artificial Sequence: Synthetic oligonucleotide
  Target: FXN; (+) strand; PAM type: YTN; PAM sequence: TTA
tatattgctgctccagggca

SEQ ID NO: 35518 - DNA, 20 bp, Artificial Sequence
  Description of Artificial Sequence: Synthetic oligonucleotide
  Target: FXN; (+) strand; PAM type: YTN; PAM sequence: TTG
ctgctccagggcatttaatc

SEQ ID NO: 35519 - DNA, 20 bp, Artificial Sequence
  Description of Artificial Sequence: Synthetic oligonucleotide
  Target: FXN; (+) strand; PAM type: YTN; PAM sequence: CTG
ctccagggcatttaatccct

SEQ ID NO: 35520 - DNA, 20 bp, Artificial Sequence
  Description of Artificial Sequence: Synthetic oligonucleotide
  Target: FXN; (+) strand; PAM type: YTN; PAM sequence: CTC
cagggcatttaatccctcct

SEQ ID NO: 35521 - DNA, 20 bp, Artificial Sequence
  Description of Artificial Sequence: Synthetic oligonucleotide
  Target: FXN; (+) strand; PAM type: YTN; PAM sequence: TTT
aatccctcctgccttttcca

SEQ ID NO: 35522 - DNA, 20 bp, Artificial Sequence
  Description of Artificial Sequence: Synthetic oligonucleotide
  Target: FXN; (+) strand; PAM type: YTN; PAM sequence: TTA
atccctcctgccttttccat

SEQ ID NO: 35523 - DNA, 20 bp, Artificial Sequence
  Description of Artificial Sequence: Synthetic oligonucleotide
  Target: FXN; (+) strand; PAM type: YTN; PAM sequence: CTC
ctgccttttccattgatgtg

SEQ ID NO: 35524 - DNA, 20 bp, Artificial Sequence
  Description of Artificial Sequence: Synthetic oligonucleotide
  Target: FXN; (+) strand; PAM type: YTN; PAM sequence: CTG
ccttttccattgatgtgctt

SEQ ID NO: 35525 - DNA, 20 bp, Artificial Sequence
  Description of Artificial Sequence: Synthetic oligonucleotide
  Target: FXN; (+) strand; PAM type: YTN; PAM sequence: CTT
ttccattgatgtgctttcaa

SEQ ID NO: 35526 - DNA, 20 bp, Artificial Sequence
  Description of Artificial Sequence: Synthetic oligonucleotide
  Target: FXN; (+) strand; PAM type: YTN; PAM sequence: TTT
tccattgatgtgctttcaat

SEQ ID NO: 35527 - DNA, 20 bp, Artificial Sequence
  Description of Artificial Sequence: Synthetic oligonucleotide
  Target: FXN; (+) strand; PAM type: YTN; PAM sequence: TTT
ccattgatgtgctttcaatc

SEQ ID NO: 35528 - DNA, 20 bp, Artificial Sequence
  Description of Artificial Sequence: Synthetic oligonucleotide
  Target: FXN; (+) strand; PAM type: YTN; PAM sequence: TTC
cattgatgtgctttcaatct

SEQ ID NO: 35529 - DNA, 20 bp, Artificial Sequence
  Description of Artificial Sequence: Synthetic oligonucleotide
  Target: FXN; (+) strand; PAM type: YTN; PAM sequence: TTG
atgtgctttcaatctagagg

SEQ ID NO: 35530 - DNA, 20 bp, Artificial Sequence
  Description of Artificial Sequence: Synthetic oligonucleotide
  Target: FXN; (+) strand; PAM type: YTN; PAM sequence: CTT
tcaatctagaggaataaaag

SEQ ID NO: 35531 - DNA, 20 bp, Artificial Sequence
  Description of Artificial Sequence: Synthetic oligonucleotide
  Target: FXN; (+) strand; PAM type: YTN; PAM sequence: TTT
caatctagaggaataaaaga

SEQ ID NO: 35532 - DNA, 20 bp, Artificial Sequence
  Description of Artificial Sequence: Synthetic oligonucleotide
  Target: FXN; (+) strand; PAM type: YTN; PAM sequence: TTC
aatctagaggaataaaagat

SEQ ID NO: 35533 - DNA, 20 bp, Artificial Sequence
  Description of Artificial Sequence: Synthetic oligonucleotide
  Target: FXN; (+) strand; PAM type: YTN; PAM sequence: CTA
gaggaataaaagattgtgtt

SEQ ID NO: 35534 - DNA, 20 bp, Artificial Sequence
  Description of Artificial Sequence: Synthetic oligonucleotide
  Target: FXN; (+) strand; PAM type: YTN; PAM sequence: TTG
tgttggagacacaatgtggc

SEQ ID NO: 35535 - DNA, 20 bp, Artificial Sequence
  Description of Artificial Sequence: Synthetic oligonucleotide
  Target: FXN; (+) strand; PAM type: YTN; PAM sequence: TTG
gagacacaatgtggcctgca

SEQ ID NO: 35536 - DNA, 20 bp, Artificial Sequence
  Description of Artificial Sequence: Synthetic oligonucleotide
  Target: FXN; (+) strand; PAM type: YTN; PAM sequence: CTG
catagcatctgaaagcctga

SEQ ID NO: 35537 - DNA, 20 bp, Artificial Sequence
  Description of Artificial Sequence: Synthetic oligonucleotide
  Target: FXN; (+) strand; PAM type: YTN; PAM sequence: CTG
aaagcctgagaacatgcagg

SEQ ID NO: 35538 - DNA, 20 bp, Artificial Sequence
  Description of Artificial Sequence: Synthetic oligonucleotide
  Target: FXN; (+) strand; PAM type: YTN; PAM sequence: CTG
agaacatgcagggagagaca

SEQ ID NO: 35539 - DNA, 20 bp, Artificial Sequence
  Description of Artificial Sequence: Synthetic oligonucleotide
  Target: FXN; (+) strand; PAM type: YTN; PAM sequence: CTC
atccctcagcagcctggctg

SEQ ID NO: 35540 - DNA, 20 bp, Artificial Sequence
  Description of Artificial Sequence: Synthetic oligonucleotide
  Target: FXN; (+) strand; PAM type: YTN; PAM sequence: CTC
agcagcctggctgctgttga

SEQ ID NO: 35541 - DNA, 20 bp, Artificial Sequence
  Description of Artificial Sequence: Synthetic oligonucleotide
  Target: FXN; (+) strand; PAM type: YTN; PAM sequence: CTG
gctgctgttgaagtggttgt

SEQ ID NO: 35542 - DNA, 20 bp, Artificial Sequence
  Description of Artificial Sequence: Synthetic oligonucleotide
  Target: FXN; (+) strand; PAM type: YTN; PAM sequence: CTG
ctgttgaagtggttgtaaga

SEQ ID NO: 35543 - DNA, 20 bp, Artificial Sequence
  Description of Artificial Sequence: Synthetic oligonucleotide
  Target: FXN; (+) strand; PAM type: YTN; PAM sequence: CTG
ttgaagtggttgtaagaaag

SEQ ID NO: 35544 - DNA, 20 bp, Artificial Sequence
  Description of Artificial Sequence: Synthetic oligonucleotide
  Target: FXN; (+) strand; PAM type: YTN; PAM sequence: TTG
aagtggttgtaagaaagtaa

SEQ ID NO: 35545 - DNA, 20 bp, Artificial Sequence
  Description of Artificial Sequence: Synthetic oligonucleotide
  Target: FXN; (+) strand; PAM type: YTN; PAM sequence: TTG
taagaaagtaaaagagaaat

SEQ ID NO: 35546 - DNA, 20 bp, Artificial Sequence
  Description of Artificial Sequence: Synthetic oligonucleotide
  Target: FXN; (+) strand; PAM type: YTN; PAM sequence: TTC
tcagatccagtcattcatta

SEQ ID NO: 35547 - DNA, 20 bp, Artificial Sequence
  Description of Artificial Sequence: Synthetic oligonucleotide
  Target: FXN; (+) strand; PAM type: YTN; PAM sequence: CTC
agatccagtcattcattagc

SEQ ID NO: 35548 - DNA, 20 bp, Artificial Sequence
  Description of Artificial Sequence: Synthetic oligonucleotide
  Target: FXN; (+) strand; PAM type: YTN; PAM sequence: TTC
attagcacttccaaagagag

SEQ ID NO: 35549 - DNA, 20 bp, Artificial Sequence
  Description of Artificial Sequence: Synthetic oligonucleotide
  Target: FXN; (+) strand; PAM type: YTN; PAM sequence: TTA
gcacttccaaagagagcatg

SEQ ID NO: 35550 - DNA, 20 bp, Artificial Sequence
  Description of Artificial Sequence: Synthetic oligonucleotide
  Target: FXN; (+) strand; PAM type: YTN; PAM sequence: CTT
ccaaagagagcatgttgact

SEQ ID NO: 35551 - DNA, 20 bp, Artificial Sequence
  Description of Artificial Sequence: Synthetic oligonucleotide
  Target: FXN; (+) strand; PAM type: YTN; PAM sequence: TTC
caaagagagcatgttgactg

SEQ ID NO: 35552 - DNA, 20 bp, Artificial Sequence
  Description of Artificial Sequence: Synthetic oligonucleotide
  Target: FXN; (+) strand; PAM type: YTN; PAM sequence: TTG
actgtgaattgggaaagggc

SEQ ID NO: 35553 - DNA, 20 bp, Artificial Sequence
  Description of Artificial Sequence: Synthetic oligonucleotide
  Target: FXN; (+) strand; PAM type: YTN; PAM sequence: CTG
tgaattgggaaagggccaga

SEQ ID NO: 35554 - DNA, 20 bp, Artificial Sequence
  Description of Artificial Sequence: Synthetic oligonucleotide
  Target: FXN; (+) strand; PAM type: YTN; PAM sequence: TTG
ggaaagggccagataaaact

SEQ ID NO: 35555 - DNA, 20 bp, Artificial Sequence
  Description of Artificial Sequence: Synthetic oligonucleotide
  Target: FXN; (+) strand; PAM type: YTN; PAM sequence: CTA
gcatagaattctttgaaaga

SEQ ID NO: 35556 - DNA, 20 bp, Artificial Sequence
  Description of Artificial Sequence: Synthetic oligonucleotide
  Target: FXN; (+) strand; PAM type: YTN; PAM sequence: TTC
tttgaaagactaacggtatt

SEQ ID NO: 35557 - DNA, 20 bp, Artificial Sequence
  Description of Artificial Sequence: Synthetic oligonucleotide
  Target: FXN; (+) strand; PAM type: YTN; PAM sequence: CTT
tgaaagactaacggtatttg

SEQ ID NO: 35558 - DNA, 20 bp, Artificial Sequence
  Description of Artificial Sequence: Synthetic oligonucleotide
  Target: FXN; (+) strand; PAM type: YTN; PAM sequence: TTT
gaaagactaacggtatttgc

SEQ ID NO: 35559 - DNA, 20 bp, Artificial Sequence
  Description of Artificial Sequence: Synthetic oligonucleotide
  Target: FXN; (+) strand; PAM type: YTN; PAM sequence: TTG
aaagactaacggtatttgca

SEQ ID NO: 35560 - DNA, 20 bp, Artificial Sequence
  Description of Artificial Sequence: Synthetic oligonucleotide
  Target: FXN; (+) strand; PAM type: YTN; PAM sequence: CTA
acggtatttgcattttttaa

SEQ ID NO: 35561 - DNA, 20 bp, Artificial Sequence
  Description of Artificial Sequence: Synthetic oligonucleotide
  Target: FXN; (+) strand; PAM type: YTN; PAM sequence: TTT
gcattttttaaaaattataa

SEQ ID NO: 35562 - DNA, 20 bp, Artificial Sequence
  Description of Artificial Sequence: Synthetic oligonucleotide
  Target: FXN; (+) strand; PAM type: YTN; PAM sequence: TTG
cattttttaaaaattataac

SEQ ID NO: 35563 - DNA, 20 bp, Artificial Sequence
  Description of Artificial Sequence: Synthetic oligonucleotide
  Target: FXN; (+) strand; PAM type: YTN; PAM sequence: TTT
tttaaaaattataaccttac

SEQ ID NO: 35564 - DNA, 20 bp, Artificial Sequence
  Description of Artificial Sequence: Synthetic oligonucleotide
  Target: FXN; (+) strand; PAM type: YTN; PAM sequence: TTT
ttaaaaattataaccttact

SEQ ID NO: 35565 - DNA, 20 bp, Artificial Sequence
  Description of Artificial Sequence: Synthetic oligonucleotide
  Target: FXN; (+) strand; PAM type: YTN; PAM sequence: TTT
taaaaattataaccttactc

SEQ ID NO: 35566 - DNA, 20 bp, Artificial Sequence
  Description of Artificial Sequence: Synthetic oligonucleotide
  Target: FXN; (+) strand; PAM type: YTN; PAM sequence: TTT
aaaaattataaccttactct

SEQ ID NO: 35567 - DNA, 20 bp, Artificial Sequence
  Description of Artificial Sequence: Synthetic oligonucleotide
  Target: FXN; (+) strand; PAM type: YTN; PAM sequence: TTA
aaaattataaccttactcta

SEQ ID NO: 35568 - DNA, 20 bp, Artificial Sequence
  Description of Artificial Sequence: Synthetic oligonucleotide
  Target: FXN; (+) strand; PAM type: YTN; PAM sequence: TTA
taaccttactctacccccta

SEQ ID NO: 35569 - DNA, 20 bp, Artificial Sequence
  Description of Artificial Sequence: Synthetic oligonucleotide
  Target: FXN; (+) strand; PAM type: YTN; PAM sequence: CTT
actctaccccctaacattga

SEQ ID NO: 35570 - DNA, 20 bp, Artificial Sequence
  Description of Artificial Sequence: Synthetic oligonucleotide
  Target: FXN; (+) strand; PAM type: YTN; PAM sequence: TTA
ctctaccccctaacattgac

SEQ ID NO: 35571 - DNA, 20 bp, Artificial Sequence
  Description of Artificial Sequence: Synthetic oligonucleotide
  Target: FXN; (+) strand; PAM type: YTN; PAM sequence: CTC
taccccctaacattgacatc

SEQ ID NO: 35572 - DNA, 20 bp, Artificial Sequence
  Description of Artificial Sequence: Synthetic oligonucleotide
  Target: FXN; (+) strand; PAM type: YTN; PAM sequence: CTA
ccccctaacattgacatcat

SEQ ID NO: 35573 - DNA, 20 bp, Artificial Sequence
  Description of Artificial Sequence: Synthetic oligonucleotide
  Target: FXN; (+) strand; PAM type: YTN; PAM sequence: CTA
acattgacatcatttttagg

SEQ ID NO: 35574 - DNA, 20 bp, Artificial Sequence
  Description of Artificial Sequence: Synthetic oligonucleotide
  Target: FXN; (+) strand; PAM type: YTN; PAM sequence: TTG
acatcatttttaggtaatta

SEQ ID NO: 35575 - DNA, 20 bp, Artificial Sequence
  Description of Artificial Sequence: Synthetic oligonucleotide
  Target: FXN; (+) strand; PAM type: YTN; PAM sequence: TTT
ttaggtaattaatattttcc

SEQ ID NO: 35576 - DNA, 20 bp, Artificial Sequence
  Description of Artificial Sequence: Synthetic oligonucleotide
  Target: FXN; (+) strand; PAM type: YTN; PAM sequence: TTT
taggtaattaatattttccc

SEQ ID NO: 35577 - DNA, 20 bp, Artificial Sequence
  Description of Artificial Sequence: Synthetic oligonucleotide
  Target: FXN; (+) strand; PAM type: YTN; PAM sequence: TTT
aggtaattaatattttccca

SEQ ID NO: 35578 - DNA, 20 bp, Artificial Sequence
  Description of Artificial Sequence: Synthetic oligonucleotide
  Target: FXN; (+) strand; PAM type: YTN; PAM sequence: TTA
ggtaattaatattttcccat

SEQ ID NO: 35579 - DNA, 20 bp, Artificial Sequence
  Description of Artificial Sequence: Synthetic oligonucleotide
  Target: FXN; (+) strand; PAM type: YTN; PAM sequence: TTA
atattttcccatttattatt

SEQ ID NO: 35580 - DNA, 20 bp, Artificial Sequence
  Description of Artificial Sequence: Synthetic oligonucleotide
  Target: FXN; (+) strand; PAM type: YTN; PAM sequence: TTT
tcccatttattattctgtga

SEQ ID NO: 35581 - DNA, 20 bp, Artificial Sequence
  Description of Artificial Sequence: Synthetic oligonucleotide
  Target: FXN; (+) strand; PAM type: YTN; PAM sequence: TTT
cccatttattattctgtgat

SEQ ID NO: 35582 - DNA, 20 bp, Artificial Sequence
  Description of Artificial Sequence: Synthetic oligonucleotide
  Target: FXN; (+) strand; PAM type: YTN; PAM sequence: TTC
ccatttattattctgtgatc

SEQ ID NO: 35583 - DNA, 20 bp, Artificial Sequence
  Description of Artificial Sequence: Synthetic oligonucleotide
  Target: FXN; (+) strand; PAM type: YTN; PAM sequence: TTT
attattctgtgatctctaat

SEQ ID NO: 35584 - DNA, 20 bp, Artificial Sequence
  Description of Artificial Sequence: Synthetic oligonucleotide
  Target: FXN; (+) strand; PAM type: YTN; PAM sequence: TTA
ttattctgtgatctctaatg

SEQ ID NO: 35585 - DNA, 20 bp, Artificial Sequence
  Description of Artificial Sequence: Synthetic oligonucleotide
  Target: FXN; (+) strand; PAM type: YTN; PAM sequence: TTA
ttctgtgatctctaatgctt

SEQ ID NO: 35586 - DNA, 20 bp, Artificial Sequence
  Description of Artificial Sequence: Synthetic oligonucleotide
  Target: FXN; (+) strand; PAM type: YTN; PAM sequence: TTC
tgtgatctctaatgctttgt

SEQ ID NO: 35587 - DNA, 20 bp, Artificial Sequence
  Description of Artificial Sequence: Synthetic oligonucleotide
  Target: FXN; (+) strand; PAM type: YTN; PAM sequence: CTG
tgatctctaatgctttgttc

SEQ ID NO: 35588 - DNA, 20 bp, Artificial Sequence
  Description of Artificial Sequence: Synthetic oligonucleotide
  Target: FXN; (+) strand; PAM type: YTN; PAM sequence: CTC
taatgctttgttcagaataa

SEQ ID NO: 35589 - DNA, 20 bp, Artificial Sequence
  Description of Artificial Sequence: Synthetic oligonucleotide
  Target: FXN; (+) strand; PAM type: YTN; PAM sequence: CTA
atgctttgttcagaataaat

SEQ ID NO: 35590 - DNA, 20 bp, Artificial Sequence
  Description of Artificial Sequence: Synthetic oligonucleotide
  Target: FXN; (+) strand; PAM type: YTN; PAM sequence: CTT
tgttcagaataaatagtgtg

SEQ ID NO: 35591 - DNA, 20 bp, Artificial Sequence
  Description of Artificial Sequence: Synthetic oligonucleotide
  Target: FXN; (+) strand; PAM type: YTN; PAM sequence: TTT
gttcagaataaatagtgtgt

SEQ ID NO: 35592 - DNA, 20 bp, Artificial Sequence
  Description of Artificial Sequence: Synthetic oligonucleotide
  Target: FXN; (+) strand; PAM type: YTN; PAM sequence: TTG
ttcagaataaatagtgtgtt

SEQ ID NO: 35593 - DNA, 20 bp, Artificial Sequence
  Description of Artificial Sequence: Synthetic oligonucleotide
  Target: FXN; (+) strand; PAM type: YTN; PAM sequence: TTC
agaataaatagtgtgtttcc

SEQ ID NO: 35594 - DNA, 20 bp, Artificial Sequence
  Description of Artificial Sequence: Synthetic oligonucleotide
  Target: FXN; (+) strand; PAM type: YTN; PAM sequence: TTT
cctttccccacactttcatc

SEQ ID NO: 35595 - DNA, 20 bp, Artificial Sequence
  Description of Artificial Sequence: Synthetic oligonucleotide
  Target: FXN; (+) strand; PAM type: YTN; PAM sequence: TTC
ctttccccacactttcatcc

SEQ ID NO: 35596 - DNA, 20 bp, Artificial Sequence
  Description of Artificial Sequence: Synthetic oligonucleotide
  Target: FXN; (+) strand; PAM type: YTN; PAM sequence: CTT
tccccacactttcatccaag

SEQ ID NO: 35597 - DNA, 20 bp, Artificial Sequence
  Description of Artificial Sequence: Synthetic oligonucleotide
  Target: FXN; (+) strand; PAM type: YTN; PAM sequence: TTT
ccccacactttcatccaaga

SEQ ID NO: 35598 - DNA, 20 bp, Artificial Sequence
  Description of Artificial Sequence: Synthetic oligonucleotide
  Target: FXN; (+) strand; PAM type: YTN; PAM sequence: TTC
cccacactttcatccaagaa

SEQ ID NO: 35599 - DNA, 20 bp, Artificial Sequence
  Description of Artificial Sequence: Synthetic oligonucleotide
  Target: FXN; (+) strand; PAM type: YTN; PAM sequence: CTT
tcatccaagaagtgtgctag

SEQ ID NO: 35600 - DNA, 20 bp, Artificial Sequence
  Description of Artificial Sequence: Synthetic oligonucleotide
  Target: FXN; (+) strand; PAM type: YTN; PAM sequence: TTT
catccaagaagtgtgctaga

SEQ ID NO: 35601 - DNA, 20 bp, Artificial Sequence
  Description of Artificial Sequence: Synthetic oligonucleotide
  Target: FXN; (+) strand; PAM type: YTN; PAM sequence: TTC
atccaagaagtgtgctagag

SEQ ID NO: 35602 - DNA, 20 bp, Artificial Sequence
  Description of Artificial Sequence: Synthetic oligonucleotide
  Target: FXN; (+) strand; PAM type: YTN; PAM sequence: CTA
gagttcaacaaaaacagcac

SEQ ID NO: 35603 - DNA, 20 bp, Artificial Sequence
  Description of Artificial Sequence: Synthetic oligonucleotide
  Target: FXN; (+) strand; PAM type: YTN; PAM sequence: TTC
aacaaaaacagcactagaaa

SEQ ID NO: 35604 - DNA, 20 bp, Artificial Sequence
  Description of Artificial Sequence: Synthetic oligonucleotide
  Target: FXN; (+) strand; PAM type: YTN; PAM sequence: CTA
gaaatcactgtcattctagg

SEQ ID NO: 35605 - DNA, 20 bp, Artificial Sequence
  Description of Artificial Sequence: Synthetic oligonucleotide
  Target: FXN; (+) strand; PAM type: YTN; PAM sequence: CTG
tcattctaggaaggccctaa

SEQ ID NO: 35606 - DNA, 20 bp, Artificial Sequence
  Description of Artificial Sequence: Synthetic oligonucleotide
  Target: FXN; (+) strand; PAM type: YTN; PAM sequence: TTC
taggaaggccctaattcaca

SEQ ID NO: 35607 - DNA, 20 bp, Artificial Sequence
  Description of Artificial Sequence: Synthetic oligonucleotide
  Target: FXN; (+) strand; PAM type: YTN; PAM sequence: CTA
ggaaggccctaattcacaga

SEQ ID NO: 35608 - DNA, 20 bp, Artificial Sequence
  Description of Artificial Sequence: Synthetic oligonucleotide
  Target: FXN; (+) strand; PAM type: YTN; PAM sequence: CTA
attcacagattgtattggtt

SEQ ID NO: 35609 - DNA, 20 bp, Artificial Sequence
  Description of Artificial Sequence: Synthetic oligonucleotide
  Target: FXN; (+) strand; PAM type: YTN; PAM sequence: TTC
acagattgtattggttttta

SEQ ID NO: 35610 - DNA, 20 bp, Artificial Sequence
  Description of Artificial Sequence: Synthetic oligonucleotide
  Target: FXN; (+) strand; PAM type: YTN; PAM sequence: TTG
tattggtttttagacccagt

SEQ ID NO: 35611 - DNA, 20 bp, Artificial Sequence
  Description of Artificial Sequence: Synthetic oligonucleotide
  Target: FXN; (+) strand; PAM type: YTN; PAM sequence: TTG
gtttttagacccagttagtg

SEQ ID NO: 35612 - DNA, 20 bp, Artificial Sequence
  Description of Artificial Sequence: Synthetic oligonucleotide
  Target: FXN; (+) strand; PAM type: YTN; PAM sequence: TTT
ttagacccagttagtgtgct

SEQ ID NO: 35613 - DNA, 20 bp, Artificial Sequence
  Description of Artificial Sequence: Synthetic oligonucleotide
  Target: FXN; (+) strand; PAM type: YTN; PAM sequence: TTT
tagacccagttagtgtgctg

SEQ ID NO: 35614 - DNA, 20 bp, Artificial Sequence
  Description of Artificial Sequence: Synthetic oligonucleotide
  Target: FXN; (+) strand; PAM type: YTN; PAM sequence: TTT
agacccagttagtgtgctgg

SEQ ID NO: 35615 - DNA, 20 bp, Artificial Sequence
  Description of Artificial Sequence: Synthetic oligonucleotide
  Target: FXN; (+) strand; PAM type: YTN; PAM sequence: TTA
gacccagttagtgtgctgga

SEQ ID NO: 35616 - DNA, 20 bp, Artificial Sequence
  Description of Artificial Sequence: Synthetic oligonucleotide
  Target: FXN; (+) strand; PAM type: YTN; PAM sequence: TTA
gtgtgctggaggttggagga

SEQ ID NO: 35617 - DNA, 20 bp, Artificial Sequence
  Description of Artificial Sequence: Synthetic oligonucleotide
  Target: FXN; (+) strand; PAM type: YTN; PAM sequence: CTG
gaggttggaggattttaacc

SEQ ID NO: 35618 - DNA, 20 bp, Artificial Sequence
  Description of Artificial Sequence: Synthetic oligonucleotide
  Target: FXN; (+) strand; PAM type: YTN; PAM sequence: TTG
gaggattttaacctctgtgg

SEQ ID NO: 35619 - DNA, 20 bp, Artificial Sequence
  Description of Artificial Sequence: Synthetic oligonucleotide
  Target: FXN; (+) strand; PAM type: YTN; PAM sequence: TTT
taacctctgtgggccaacta

SEQ ID NO: 35620 - DNA, 20 bp, Artificial Sequence
  Description of Artificial Sequence: Synthetic oligonucleotide
  Target: FXN; (+) strand; PAM type: YTN; PAM sequence: TTT
aacctctgtgggccaactag

SEQ ID NO: 35621 - DNA, 20 bp, Artificial Sequence
  Description of Artificial Sequence: Synthetic oligonucleotide
  Target: FXN; (+) strand; PAM type: YTN; PAM sequence: TTA
acctctgtgggccaactagc

SEQ ID NO: 35622 - DNA, 20 bp, Artificial Sequence
  Description of Artificial Sequence: Synthetic oligonucleotide
  Target: FXN; (+) strand; PAM type: YTN; PAM sequence: CTC
tgtgggccaactagcctctg

SEQ ID NO: 35623 - DNA, 20 bp, Artificial Sequence
  Description of Artificial Sequence: Synthetic oligonucleotide
  Target: FXN; (+) strand; PAM type: YTN; PAM sequence: CTG
tgggccaactagcctctgtg

SEQ ID NO: 35624 - DNA, 20 bp, Artificial Sequence
  Description of Artificial Sequence: Synthetic oligonucleotide
  Target: FXN; (+) strand; PAM type: YTN; PAM sequence: CTA
gcctctgtggcctcagtcat

SEQ ID NO: 35625 - DNA, 20 bp, Artificial Sequence
  Description of Artificial Sequence: Synthetic oligonucleotide
  Target: FXN; (+) strand; PAM type: YTN; PAM sequence: CTC
tgtggcctcagtcattcttc

SEQ ID NO: 35626 - DNA, 20 bp, Artificial Sequence
  Description of Artificial Sequence: Synthetic oligonucleotide
  Target: FXN; (+) strand; PAM type: YTN; PAM sequence: CTG
tggcctcagtcattcttcct

SEQ ID NO: 35627 - DNA, 20 bp, Artificial Sequence
  Description of Artificial Sequence: Synthetic oligonucleotide
  Target: FXN; (+) strand; PAM type: YTN; PAM sequence: CTC
agtcattcttcctgaccctg

SEQ ID NO: 35628 - DNA, 20 bp, Artificial Sequence
  Description of Artificial Sequence: Synthetic oligonucleotide
  Target: FXN; (+) strand; PAM type: YTN; PAM sequence: TTC
ttcctgaccctggctgtgct

SEQ ID NO: 35629 - DNA, 20 bp, Artificial Sequence
  Description of Artificial Sequence: Synthetic oligonucleotide
  Target: FXN; (+) strand; PAM type: YTN; PAM sequence: CTT
cctgaccctggctgtgcttg

SEQ ID NO: 35630 - DNA, 20 bp, Artificial Sequence
  Description of Artificial Sequence: Synthetic oligonucleotide
  Target: FXN; (+) strand; PAM type: YTN; PAM sequence: TTC
ctgaccctggctgtgcttga

SEQ ID NO: 35631 - DNA, 20 bp, Artificial Sequence
  Description of Artificial Sequence: Synthetic oligonucleotide
  Target: FXN; (+) strand; PAM type: YTN; PAM sequence: CTG
accctggctgtgcttgagcc

SEQ ID NO: 35632 - DNA, 20 bp, Artificial Sequence
  Description of Artificial Sequence: Synthetic oligonucleotide
  Target: FXN; (+) strand; PAM type: YTN; PAM sequence: CTG
gctgtgcttgagcctgtgtg

SEQ ID NO: 35633 - DNA, 20 bp, Artificial Sequence
  Description of Artificial Sequence: Synthetic oligonucleotide
  Target: FXN; (+) strand; PAM type: YTN; PAM sequence: CTG
tgcttgagcctgtgtgttct

SEQ ID NO: 35634 - DNA, 20 bp, Artificial Sequence
  Description of Artificial Sequence: Synthetic oligonucleotide
  Target: FXN; (+) strand; PAM type: YTN; PAM sequence: CTT
gagcctgtgtgttcttatcc

SEQ ID NO: 35635 - DNA, 20 bp, Artificial Sequence
  Description of Artificial Sequence: Synthetic oligonucleotide
  Target: FXN; (+) strand; PAM type: YTN; PAM sequence: TTG
agcctgtgtgttcttatcct

SEQ ID NO: 35636 - DNA, 20 bp, Artificial Sequence
  Description of Artificial Sequence: Synthetic oligonucleotide
  Target: FXN; (+) strand; PAM type: YTN; PAM sequence: CTG
tgtgttcttatccttcatct

SEQ ID NO: 35637 - DNA, 20 bp, Artificial Sequence
  Description of Artificial Sequence: Synthetic oligonucleotide
  Target: FXN; (+) strand; PAM type: YTN; PAM sequence: TTC
ttatccttcatctccggggg

SEQ ID NO: 35638 - DNA, 20 bp, Artificial Sequence
  Description of Artificial Sequence: Synthetic oligonucleotide
  Target: FXN; (+) strand; PAM type: YTN; PAM sequence: CTT
atccttcatctccgggggaa

SEQ ID NO: 35639 - DNA, 20 bp, Artificial Sequence
  Description of Artificial Sequence: Synthetic oligonucleotide
  Target: FXN; (+) strand; PAM type: YTN; PAM sequence: TTA
tccttcatctccgggggaac

SEQ ID NO: 35640 - DNA, 20 bp, Artificial Sequence
  Description of Artificial Sequence: Synthetic oligonucleotide
  Target: FXN; (+) strand; PAM type: YTN; PAM sequence: CTT
catctccgggggaacgaagt

SEQ ID NO: 35641 - DNA, 20 bp, Artificial Sequence
  Description of Artificial Sequence: Synthetic oligonucleotide
  Target: FXN; (+) strand; PAM type: YTN; PAM sequence: TTC
atctccgggggaacgaagtg

SEQ ID NO: 35642 - DNA, 20 bp, Artificial Sequence
  Description of Artificial Sequence: Synthetic oligonucleotide
  Target: FXN; (+) strand; PAM type: YTN; PAM sequence: CTC
cgggggaacgaagtggatca

SEQ ID NO: 35643 - DNA, 20 bp, Artificial Sequence
  Description of Artificial Sequence: Synthetic oligonucleotide
  Target: FXN; (+) strand; PAM type: YTN; PAM sequence: CTC
ggtccagcgatcacttttgg

SEQ ID NO: 35644 - DNA, 20 bp, Artificial Sequence
  Description of Artificial Sequence: Synthetic oligonucleotide
  Target: FXN; (+) strand; PAM type: YTN; PAM sequence: CTT
ttggggatcagtggctttgt

SEQ ID NO: 35645 - DNA, 20 bp, Artificial Sequence
  Description of Artificial Sequence: Synthetic oligonucleotide
  Target: FXN; (+) strand; PAM type: YTN; PAM sequence: TTT
tggggatcagtggctttgta

SEQ ID NO: 35646 - DNA, 20 bp, Artificial Sequence
  Description of Artificial Sequence: Synthetic oligonucleotide
  Target: FXN; (+) strand; PAM type: YTN; PAM sequence: TTT
ggggatcagtggctttgtag

SEQ ID NO: 35647 - DNA, 20 bp, Artificial Sequence
  Description of Artificial Sequence: Synthetic oligonucleotide
  Target: FXN; (+) strand; PAM type: YTN; PAM sequence: TTG
gggatcagtggctttgtaga

SEQ ID NO: 35648 - DNA, 20 bp, Artificial Sequence
  Description of Artificial Sequence: Synthetic oligonucleotide
  Target: FXN; (+) strand; PAM type: YTN; PAM sequence: CTT
tgtagatatcgggcaggcac

SEQ ID NO: 35649 - DNA, 20 bp, Artificial Sequence
  Description of Artificial Sequence: Synthetic oligonucleotide
  Target: FXN; (+) strand; PAM type: YTN; PAM sequence: TTT
gtagatatcgggcaggcact

SEQ ID NO: 35650 - DNA, 20 bp, Artificial Sequence
  Description of Artificial Sequence: Synthetic oligonucleotide
  Target: FXN; (+) strand; PAM type: YTN; PAM sequence: TTG
tagatatcgggcaggcactt

SEQ ID NO: 35651 - DNA, 20 bp, Artificial Sequence
  Description of Artificial Sequence: Synthetic oligonucleotide
  Target: FXN; (+) strand; PAM type: YTN; PAM sequence: CTT
accccaaaagaactttcccc

SEQ ID NO: 35652 - DNA, 20 bp, Artificial Sequence
  Description of Artificial Sequence: Synthetic oligonucleotide
  Target: FXN; (+) strand; PAM type: YTN; PAM sequence: TTA
ccccaaaagaactttcccca

SEQ ID NO: 35653 - DNA, 20 bp, Artificial Sequence
  Description of Artificial Sequence: Synthetic oligonucleotide
  Target: FXN; (+) strand; PAM type: YTN; PAM sequence: CTT
tccccatatctgaagactga

SEQ ID NO: 35654 - DNA, 20 bp, Artificial Sequence
  Description of Artificial Sequence: Synthetic oligonucleotide
  Target: FXN; (+) strand; PAM type: YTN; PAM sequence: TTT
ccccatatctgaagactgaa

SEQ ID NO: 35655 - DNA, 20 bp, Artificial Sequence
  Description of Artificial Sequence: Synthetic oligonucleotide
  Target: FXN; (+) strand; PAM type: YTN; PAM sequence: TTC
cccatatctgaagactgaaa

SEQ ID NO: 35656 - DNA, 20 bp, Artificial Sequence
  Description of Artificial Sequence: Synthetic oligonucleotide
  Target: FXN; (+) strand; PAM type: YTN; PAM sequence: CTG
aagactgaaaacgtccatat

SEQ ID NO: 35657 - DNA, 20 bp, Artificial Sequence
  Description of Artificial Sequence: Synthetic oligonucleotide
  Target: FXN; (+) strand; PAM type: YTN; PAM sequence: CTG
aaaacgtccatatcgtattt

SEQ ID NO: 35658 - DNA, 20 bp, Artificial Sequence
  Description of Artificial Sequence: Synthetic oligonucleotide
  Target: FXN; (+) strand; PAM type: YTN; PAM sequence: TTT
ggacacactgcccagcaata

SEQ ID NO: 35659 - DNA, 20 bp, Artificial Sequence
  Description of Artificial Sequence: Synthetic oligonucleotide
  Target: FXN; (+) strand; PAM type: YTN; PAM sequence: TTG
gacacactgcccagcaatac

SEQ ID NO: 35660 - DNA, 20 bp, Artificial Sequence
  Description of Artificial Sequence: Synthetic oligonucleotide
  Target: FXN; (+) strand; PAM type: YTN; PAM sequence: CTG
cccagcaatacgctctagct

SEQ ID NO: 35661 - DNA, 20 bp, Artificial Sequence
  Description of Artificial Sequence: Synthetic oligonucleotide
  Target: FXN; (+) strand; PAM type: YTN; PAM sequence: CTC
tagctgtgttcagaagcatg

SEQ ID NO: 35662 - DNA, 20 bp, Artificial Sequence
  Description of Artificial Sequence: Synthetic oligonucleotide
  Target: FXN; (+) strand; PAM type: YTN; PAM sequence: CTA
gctgtgttcagaagcatggg

SEQ ID NO: 35663 - DNA, 20 bp, Artificial Sequence
  Description of Artificial Sequence: Synthetic oligonucleotide
  Target: FXN; (+) strand; PAM type: YTN; PAM sequence: CTG
tgttcagaagcatgggaatt

SEQ ID NO: 35664 - DNA, 20 bp, Artificial Sequence
  Description of Artificial Sequence: Synthetic oligonucleotide
  Target: FXN; (+) strand; PAM type: YTN; PAM sequence: TTC
agaagcatgggaatttggaa

SEQ ID NO: 35665 - DNA, 20 bp, Artificial Sequence
  Description of Artificial Sequence: Synthetic oligonucleotide
  Target: FXN; (+) strand; PAM type: YTN; PAM sequence: TTT
ggaaagatctgctgagcatg

SEQ ID NO: 35666 - DNA, 20 bp, Artificial Sequence
  Description of Artificial Sequence: Synthetic oligonucleotide
  Target: FXN; (+) strand; PAM type: YTN; PAM sequence: TTG
gaaagatctgctgagcatgc

SEQ ID NO: 35667 - DNA, 20 bp, Artificial Sequence
  Description of Artificial Sequence: Synthetic oligonucleotide
  Target: FXN; (+) strand; PAM type: YTN; PAM sequence: CTG
ctgagcatgccgtttactgt

SEQ ID NO: 35668 - DNA, 20 bp, Artificial Sequence
  Description of Artificial Sequence: Synthetic oligonucleotide
  Target: FXN; (+) strand; PAM type: YTN; PAM sequence: CTG
agcatgccgtttactgtcac

SEQ ID NO: 35669 - DNA, 20 bp, Artificial Sequence
  Description of Artificial Sequence: Synthetic oligonucleotide
  Target: FXN; (+) strand; PAM type: YTN; PAM sequence: TTT
actgtcacagatactatctt

SEQ ID NO: 35670 - DNA, 20 bp, Artificial Sequence
  Description of Artificial Sequence: Synthetic oligonucleotide
  Target: FXN; (+) strand; PAM type: YTN; PAM sequence: TTA
ctgtcacagatactatcttc

SEQ ID NO: 35671 - DNA, 20 bp, Artificial Sequence
  Description of Artificial Sequence: Synthetic oligonucleotide
  Target: FXN; (+) strand; PAM type: YTN; PAM sequence: CTG
tcacagatactatcttcctc

SEQ ID NO: 35672 - DNA, 20 bp, Artificial Sequence
  Description of Artificial Sequence: Synthetic oligonucleotide
  Target: FXN; (+) strand; PAM type: YTN; PAM sequence: CTA
tcttcctcaaaaaaaaaaaa

SEQ ID NO: 35673 - DNA, 20 bp, Artificial Sequence
  Description of Artificial Sequence: Synthetic oligonucleotide
  Target: FXN; (+) strand; PAM type: YTN; PAM sequence: CTT
cctcaaaaaaaaaaaatata

SEQ ID NO: 35674 - DNA, 20 bp, Artificial Sequence
  Description of Artificial Sequence: Synthetic oligonucleotide
  Target: FXN; (+) strand; PAM type: YTN; PAM sequence: TTC
ctcaaaaaaaaaaaatatat

SEQ ID NO: 35675 - DNA, 20 bp, Artificial Sequence
  Description of Artificial Sequence: Synthetic oligonucleotide
  Target: FXN; (+) strand; PAM type: YTN; PAM sequence: CTC
aaaaaaaaaaaatatatata

SEQ ID NO: 35676 - DNA, 20 bp, Artificial Sequence
  Description of Artificial Sequence: Synthetic oligonucleotide
  Target: FXN; (+) strand; PAM type: YTN; PAM sequence: TTG
agactgggtgagactgaaga

SEQ ID NO: 35677 - DNA, 20 bp, Artificial Sequence
  Description of Artificial Sequence: Synthetic oligonucleotide
  Target: FXN; (+) strand; PAM type: YTN; PAM sequence: CTG
ggtgagactgaagaggtgcc

SEQ ID NO: 35678 - DNA, 20 bp, Artificial Sequence
  Description of Artificial Sequence: Synthetic oligonucleotide
  Target: FXN; (+) strand; PAM type: YTN; PAM sequence: CTG
aagaggtgccttggccagag

SEQ ID NO: 35679 - DNA, 20 bp, Artificial Sequence
  Description of Artificial Sequence: Synthetic oligonucleotide
  Target: FXN; (+) strand; PAM type: YTN; PAM sequence: CTT
ggccagagcaggccacaccc

SEQ ID NO: 35680 - DNA, 20 bp, Artificial Sequence
  Description of Artificial Sequence: Synthetic oligonucleotide
  Target: FXN; (+) strand; PAM type: YTN; PAM sequence: TTG
gccagagcaggccacaccca

SEQ ID NO: 35681 - DNA, 20 bp, Artificial Sequence
  Description of Artificial Sequence: Synthetic oligonucleotide
  Target: FXN; (+) strand; PAM type: YTN; PAM sequence: CTC
cccggtccacctcaggcccc

SEQ ID NO: 35682 - DNA, 20 bp, Artificial Sequence
  Description of Artificial Sequence: Synthetic oligonucleotide
  Target: FXN; (+) strand; PAM type: YTN; PAM sequence: CTC
aggcccctccccttcctgcg

SEQ ID NO: 35683 - DNA, 20 bp, Artificial Sequence
  Description of Artificial Sequence: Synthetic oligonucleotide
  Target: FXN; (+) strand; PAM type: YTN; PAM sequence: CTC
cccttcctgcgccgtttccg

SEQ ID NO: 35684 - DNA, 20 bp, Artificial Sequence
  Description of Artificial Sequence: Synthetic oligonucleotide
  Target: FXN; (+) strand; PAM type: YTN; PAM sequence: CTT
cctgcgccgtttccggcaga

SEQ ID NO: 35685 - DNA, 20 bp, Artificial Sequence
  Description of Artificial Sequence: Synthetic oligonucleotide
  Target: FXN; (+) strand; PAM type: YTN; PAM sequence: TTC
ctgcgccgtttccggcagat

SEQ ID NO: 35686 - DNA, 20 bp, Artificial Sequence
  Description of Artificial Sequence: Synthetic oligonucleotide
  Target: FXN; (+) strand; PAM type: YTN; PAM sequence: CTG
cgccgtttccggcagatcca

SEQ ID NO: 35687 - DNA, 20 bp, Artificial Sequence
  Description of Artificial Sequence: Synthetic oligonucleotide
  Target: FXN; (+) strand; PAM type: YTN; PAM sequence: TTT
ccggcagatccagagtggcc

SEQ ID NO: 35688 - DNA, 20 bp, Artificial Sequence
  Description of Artificial Sequence: Synthetic oligonucleotide
  Target: FXN; (+) strand; PAM type: YTN; PAM sequence: TTC
cggcagatccagagtggcca

SEQ ID NO: 35689 - DNA, 20 bp, Artificial Sequence
  Description of Artificial Sequence: Synthetic oligonucleotide
  Target: FXN; (+) strand; PAM type: YTN; PAM sequence: CTG
aggacaagctctcagtgctt

SEQ ID NO: 35690 - DNA, 20 bp, Artificial Sequence
  Description of Artificial Sequence: Synthetic oligonucleotide
  Target: FXN; (+) strand; PAM type: YTN; PAM sequence: CTC
tcagtgcttctgtgggaagt

SEQ ID NO: 35691 - DNA, 20 bp, Artificial Sequence
  Description of Artificial Sequence: Synthetic oligonucleotide
  Target: FXN; (+) strand; PAM type: YTN; PAM sequence: CTC
agtgcttctgtgggaagtgg

SEQ ID NO: 35692 - DNA, 20 bp, Artificial Sequence
  Description of Artificial Sequence: Synthetic oligonucleotide
  Target: FXN; (+) strand; PAM type: YTN; PAM sequence: CTT
ctgtgggaagtggcggcaag

SEQ ID NO: 35693 - DNA, 20 bp, Artificial Sequence
  Description of Artificial Sequence: Synthetic oligonucleotide
  Target: FXN; (+) strand; PAM type: YTN; PAM sequence: TTC
tgtgggaagtggcggcaaga

SEQ ID NO: 35694 - DNA, 20 bp, Artificial Sequence
  Description of Artificial Sequence: Synthetic oligonucleotide
  Target: FXN; (+) strand; PAM type: YTN; PAM sequence: CTG
tgggaagtggcggcaagacg

SEQ ID NO: 35695 - DNA, 20 bp, Artificial Sequence
  Description of Artificial Sequence: Synthetic oligonucleotide
  Target: FXN; (+) strand; PAM type: YTN; PAM sequence: CTC
ccagcgggggatggaggccg

SEQ ID NO: 35696 - DNA, 20 bp, Artificial Sequence
  Description of Artificial Sequence: Synthetic oligonucleotide
  Target: FXN; (+) strand; PAM type: YTN; PAM sequence: CTG
ctggtcactggaggccagga

SEQ ID NO: 35697 - DNA, 20 bp, Artificial Sequence
  Description of Artificial Sequence: Synthetic oligonucleotide
  Target: FXN; (+) strand; PAM type: YTN; PAM sequence: CTG
gtcactggaggccaggatgc

SEQ ID NO: 35698 - DNA, 20 bp, Artificial Sequence
  Description of Artificial Sequence: Synthetic oligonucleotide
  Target: FXN; (+) strand; PAM type: YTN; PAM sequence: CTG
gaggccaggatgctgcctaa

SEQ ID NO: 35699 - DNA, 20 bp, Artificial Sequence
  Description of Artificial Sequence: Synthetic oligonucleotide
  Target: FXN; (+) strand; PAM type: YTN; PAM sequence: CTG
cctaacacagccgtcccgct

SEQ ID NO: 35700 - DNA, 20 bp, Artificial Sequence
  Description of Artificial Sequence: Synthetic oligonucleotide
  Target: FXN; (+) strand; PAM type: YTN; PAM sequence: CTA
acacagccgtcccgctccgg

SEQ ID NO: 35701 - DNA, 20 bp, Artificial Sequence
  Description of Artificial Sequence: Synthetic oligonucleotide
  Target: FXN; (+) strand; PAM type: YTN; PAM sequence: CTC
cgggcctcaccaccagggcg

SEQ ID NO: 35702 - DNA, 20 bp, Artificial Sequence
  Description of Artificial Sequence: Synthetic oligonucleotide
  Target: FXN; (+) strand; PAM type: YTN; PAM sequence: CTC
accaccagggcggctctccc

SEQ ID NO: 35703 - DNA, 20 bp, Artificial Sequence
  Description of Artificial Sequence: Synthetic oligonucleotide
  Target: FXN; (+) strand; PAM type: YTN; PAM sequence: CTC
tccccactcccggcctgctg

SEQ ID NO: 35704 - DNA, 20 bp, Artificial Sequence
  Description of Artificial Sequence: Synthetic oligonucleotide
  Target: FXN; (+) strand; PAM type: YTN; PAM sequence: CTC
cccactcccggcctgctgcc

SEQ ID NO: 35705 - DNA, 20 bp, Artificial Sequence
  Description of Artificial Sequence: Synthetic oligonucleotide
  Target: FXN; (+) strand; PAM type: YTN; PAM sequence: CTC
ccggcctgctgcccacacag

SEQ ID NO: 35706 - DNA, 20 bp, Artificial Sequence
  Description of Artificial Sequence: Synthetic oligonucleotide
  Target: FXN; (+) strand; PAM type: YTN; PAM sequence: CTG
ctgcccacacagactgcggg

SEQ ID NO: 35707 - DNA, 20 bp, Artificial Sequence
  Description of Artificial Sequence: Synthetic oligonucleotide
  Target: FXN; (+) strand; PAM type: YTN; PAM sequence: CTG
cccacacagactgcggggtt

SEQ ID NO: 35708 - DNA, 20 bp, Artificial Sequence
  Description of Artificial Sequence: Synthetic oligonucleotide
  Target: FXN; (+) strand; PAM type: YTN; PAM sequence: CTG
cggggttccgggggagcagg

SEQ ID NO: 35709 - DNA, 20 bp, Artificial Sequence
  Description of Artificial Sequence: Synthetic oligonucleotide
  Target: FXN; (+) strand; PAM type: YTN; PAM sequence: TTC
cgggggagcaggacccaggc

SEQ ID NO: 35710 - DNA, 20 bp, Artificial Sequence
  Description of Artificial Sequence: Synthetic oligonucleotide
  Target: FXN; (+) strand; PAM type: YTN; PAM sequence: TTC
tgcgcctgtcttcttggaag

SEQ ID NO: 35711 - DNA, 20 bp, Artificial Sequence
  Description of Artificial Sequence: Synthetic oligonucleotide
  Target: FXN; (+) strand; PAM type: YTN; PAM sequence: CTG
cgcctgtcttcttggaagga

SEQ ID NO: 35712 - DNA, 20 bp, Artificial Sequence
  Description of Artificial Sequence: Synthetic oligonucleotide
  Target: FXN; (+) strand; PAM type: YTN; PAM sequence: CTG
tcttcttggaaggagcaggc

SEQ ID NO: 35713 - DNA, 20 bp, Artificial Sequence
  Description of Artificial Sequence: Synthetic oligonucleotide
  Target: FXN; (+) strand; PAM type: YTN; PAM sequence: CTT
cttggaaggagcaggccgga

SEQ ID NO: 35714 - DNA, 20 bp, Artificial Sequence
  Description of Artificial Sequence: Synthetic oligonucleotide
  Target: FXN; (+) strand; PAM type: YTN; PAM sequence: TTC
ttggaaggagcaggccggag

SEQ ID NO: 35715 - DNA, 20 bp, Artificial Sequence
  Description of Artificial Sequence: Synthetic oligonucleotide
  Target: FXN; (+) strand; PAM type: YTN; PAM sequence: CTT
ggaaggagcaggccggagcg

SEQ ID NO: 35716 - DNA, 20 bp, Artificial Sequence
  Description of Artificial Sequence: Synthetic oligonucleotide
  Target: FXN; (+) strand; PAM type: YTN; PAM sequence: TTG
gaaggagcaggccggagcgc

SEQ ID NO: 35717 - DNA, 20 bp, Artificial Sequence
  Description of Artificial Sequence: Synthetic oligonucleotide
  Target: FXN; (+) strand; PAM type: YTN; PAM sequence: CTG
tacctgcgaaggcacaggat

SEQ ID NO: 35718 - DNA, 20 bp, Artificial Sequence
  Description of Artificial Sequence: Synthetic oligonucleotide
  Target: FXN; (+) strand; PAM type: YTN; PAM sequence: CTG
cgaaggcacaggattccgcg

SEQ ID NO: 35719 - DNA, 20 bp, Artificial Sequence
  Description of Artificial Sequence: Synthetic oligonucleotide
  Target: FXN; (+) strand; PAM type: YTN; PAM sequence: TTC
cgcgggaagatcccgcagtt

SEQ ID NO: 35720 - DNA, 20 bp, Artificial Sequence
  Description of Artificial Sequence: Synthetic oligonucleotide
  Target: FXN; (+) strand; PAM type: YTN; PAM sequence: TTT
cgggccgtcgtcattgtttt

SEQ ID NO: 35721 - DNA, 20 bp, Artificial Sequence
  Description of Artificial Sequence: Synthetic oligonucleotide
  Target: FXN; (+) strand; PAM type: YTN; PAM sequence: TTC
gggccgtcgtcattgttttt

SEQ ID NO: 35722 - DNA, 20 bp, Artificial Sequence
  Description of Artificial Sequence: Synthetic oligonucleotide
  Target: FXN; (+) strand; PAM type: YTN; PAM sequence: TTG
tttttatacctgtggcaaat

SEQ ID NO: 35723 - DNA, 20 bp, Artificial Sequence
  Description of Artificial Sequence: Synthetic oligonucleotide
  Target: FXN; (+) strand; PAM type: YTN; PAM sequence: TTT
ttatacctgtggcaaatggc

SEQ ID NO: 35724 - DNA, 20 bp, Artificial Sequence
  Description of Artificial Sequence: Synthetic oligonucleotide
  Target: FXN; (+) strand; PAM type: YTN; PAM sequence: TTT
tatacctgtggcaaatggca

SEQ ID NO: 35725 - DNA, 20 bp, Artificial Sequence
  Description of Artificial Sequence: Synthetic oligonucleotide
  Target: FXN; (+) strand; PAM type: YTN; PAM sequence: TTT
atacctgtggcaaatggcat

SEQ ID NO: 35726 - DNA, 20 bp, Artificial Sequence
  Description of Artificial Sequence: Synthetic oligonucleotide
  Target: FXN; (+) strand; PAM type: YTN; PAM sequence: TTA
tacctgtggcaaatggcatg

SEQ ID NO: 35727 - DNA, 20 bp, Artificial Sequence
  Description of Artificial Sequence: Synthetic oligonucleotide
  Target: FXN; (+) strand; PAM type: YTN; PAM sequence: CTG
tggcaaatggcatgaccaga

SEQ ID NO: 35728 - DNA, 20 bp, Artificial Sequence
  Description of Artificial Sequence: Synthetic oligonucleotide
  Target: FXN; (+) strand; PAM type: YTN; PAM sequence: TTA
tgtctggagaaacccctgta

SEQ ID NO: 35729 - DNA, 20 bp, Artificial Sequence
  Description of Artificial Sequence: Synthetic oligonucleotide
  Target: FXN; (+) strand; PAM type: YTN; PAM sequence: CTG
gagaaacccctgtagaggag

SEQ ID NO: 35730 - DNA, 20 bp, Artificial Sequence
  Description of Artificial Sequence: Synthetic oligonucleotide
  Target: FXN; (+) strand; PAM type: YTN; PAM sequence: CTG
tagaggagcaggaggttgtg

SEQ ID NO: 35731 - DNA, 20 bp, Artificial Sequence
  Description of Artificial Sequence: Synthetic oligonucleotide
  Target: FXN; (+) strand; PAM type: YTN; PAM sequence: TTG
tggacatgctgtggcccgga

SEQ ID NO: 35732 - DNA, 20 bp, Artificial Sequence
  Description of Artificial Sequence: Synthetic oligonucleotide
  Target: FXN; (+) strand; PAM type: YTN; PAM sequence: CTG
tggcccggacagtggctgcc

SEQ ID NO: 35733 - DNA, 20 bp, Artificial Sequence
  Description of Artificial Sequence: Synthetic oligonucleotide
  Target: FXN; (+) strand; PAM type: YTN; PAM sequence: CTG
ccgagcagttggagcctgca

SEQ ID NO: 35734 - DNA, 20 bp, Artificial Sequence
  Description of Artificial Sequence: Synthetic oligonucleotide
  Target: FXN; (+) strand; PAM type: YTN; PAM sequence: TTG
gagcctgcacccgcccaact

SEQ ID NO: 35735 - DNA, 20 bp, Artificial Sequence
  Description of Artificial Sequence: Synthetic oligonucleotide
  Target: FXN; (+) strand; PAM type: YTN; PAM sequence: CTG
cacccgcccaacttggctaa

SEQ ID NO: 35736 - DNA, 20 bp, Artificial Sequence
  Description of Artificial Sequence: Synthetic oligonucleotide
  Target: FXN; (+) strand; PAM type: YTN; PAM sequence: CTT
ggctaaagaagtccccatac

SEQ ID NO: 35737 - DNA, 20 bp, Artificial Sequence
  Description of Artificial Sequence: Synthetic oligonucleotide
  Target: FXN; (+) strand; PAM type: YTN; PAM sequence: TTG
gctaaagaagtccccatact

SEQ ID NO: 35738 - DNA, 20 bp, Artificial Sequence
  Description of Artificial Sequence: Synthetic oligonucleotide
  Target: FXN; (+) strand; PAM type: YTN; PAM sequence: CTA
aagaagtccccatactctct

SEQ ID NO: 35739 - DNA, 20 bp, Artificial Sequence
  Description of Artificial Sequence: Synthetic oligonucleotide
  Target: FXN; (+) strand; PAM type: YTN; PAM sequence: CTC
tctgtggaaaagatttccag

SEQ ID NO: 35740 - DNA, 20 bp, Artificial Sequence
  Description of Artificial Sequence: Synthetic oligonucleotide
  Target: FXN; (+) strand; PAM type: YTN; PAM sequence: CTC
tgtggaaaagatttccagaa

SEQ ID NO: 35741 - DNA, 20 bp, Artificial Sequence
  Description of Artificial Sequence: Synthetic oligonucleotide
  Target: FXN; (+) strand; PAM type: YTN; PAM sequence: CTG
tggaaaagatttccagaagc

SEQ ID NO: 35742 - DNA, 20 bp, Artificial Sequence
  Description of Artificial Sequence: Synthetic oligonucleotide
  Target: FXN; (+) strand; PAM type: YTN; PAM sequence: TTT
ccagaagctgttgtgtcaat

SEQ ID NO: 35743 - DNA, 20 bp, Artificial Sequence
  Description of Artificial Sequence: Synthetic oligonucleotide
  Target: FXN; (+) strand; PAM type: YTN; PAM sequence: TTC
cagaagctgttgtgtcaata

SEQ ID NO: 35744 - DNA, 20 bp, Artificial Sequence
  Description of Artificial Sequence: Synthetic oligonucleotide
  Target: FXN; (+) strand; PAM type: YTN; PAM sequence: CTG
ttgtgtcaatatcaaagcct

SEQ ID NO: 35745 - DNA, 20 bp, Artificial Sequence
  Description of Artificial Sequence: Synthetic oligonucleotide
  Target: FXN; (+) strand; PAM type: YTN; PAM sequence: TTG
tgtcaatatcaaagcctcaa

SEQ ID NO: 35746 - DNA, 20 bp, Artificial Sequence
  Description of Artificial Sequence: Synthetic oligonucleotide
  Target: FXN; (+) strand; PAM type: YTN; PAM sequence: CTC
aaaacaacaacaacaacaac

SEQ ID NO: 35747 - DNA, 20 bp, Artificial Sequence
  Description of Artificial Sequence: Synthetic oligonucleotide
  Target: FXN; (+) strand; PAM type: YTN; PAM sequence: TTA
tcaacaataaagatcatcct

SEQ ID NO: 35748 - DNA, 20 bp, Artificial Sequence
  Description of Artificial Sequence: Synthetic oligonucleotide
  Target: FXN; (+) strand; PAM type: YTN; PAM sequence: CTT
gagtctgctttgaaaagtag

SEQ ID NO: 35749 - DNA, 20 bp, Artificial Sequence
  Description of Artificial Sequence: Synthetic oligonucleotide
  Target: FXN; (+) strand; PAM type: YTN; PAM sequence: TTG
agtctgctttgaaaagtagg

SEQ ID NO: 35750 - DNA, 20 bp, Artificial Sequence
  Description of Artificial Sequence: Synthetic oligonucleotide
  Target: FXN; (+) strand; PAM type: YTN; PAM sequence: CTG
ctttgaaaagtagggtgaaa

SEQ ID NO: 35751 - DNA, 20 bp, Artificial Sequence
  Description of Artificial Sequence: Synthetic oligonucleotide
  Target: FXN; (+) strand; PAM type: YTN; PAM sequence: CTT
tgaaaagtagggtgaaattc

SEQ ID NO: 35752 - DNA, 20 bp, Artificial Sequence
  Description of Artificial Sequence: Synthetic oligonucleotide
  Target: FXN; (+) strand; PAM type: YTN; PAM sequence: TTT
gaaaagtagggtgaaattct

SEQ ID NO: 35753 - DNA, 20 bp, Artificial Sequence
  Description of Artificial Sequence: Synthetic oligonucleotide
  Target: FXN; (+) strand; PAM type: YTN; PAM sequence: TTG
aaaagtagggtgaaattctg

SEQ ID NO: 35754 - DNA, 20 bp, Artificial Sequence
  Description of Artificial Sequence: Synthetic oligonucleotide
  Target: FXN; (+) strand; PAM type: YTN; PAM sequence: TTC
tgcagaggcattcaactggc

SEQ ID NO: 35755 - DNA, 20 bp, Artificial Sequence
  Description of Artificial Sequence: Synthetic oligonucleotide
  Target: FXN; (+) strand; PAM type: YTN; PAM sequence: CTG
cagaggcattcaactggcaa

SEQ ID NO: 35756 - DNA, 20 bp, Artificial Sequence
  Description of Artificial Sequence: Synthetic oligonucleotide
  Target: FXN; (+) strand; PAM type: YTN; PAM sequence: TTC
aactggcaagataccaccct

SEQ ID NO: 35757 - DNA, 20 bp, Artificial Sequence
  Description of Artificial Sequence: Synthetic oligonucleotide
  Target: FXN; (+) strand; PAM type: YTN; PAM sequence: CTG
gcaagataccaccctcatag

SEQ ID NO: 35758 - DNA, 20 bp, Artificial Sequence
  Description of Artificial Sequence: Synthetic oligonucleotide
  Target: FXN; (+) strand; PAM type: YTN; PAM sequence: CTC
atagccagatctgcaggtct

SEQ ID NO: 35759 - DNA, 20 bp, Artificial Sequence
  Description of Artificial Sequence: Synthetic oligonucleotide
  Target: FXN; (+) strand; PAM type: YTN; PAM sequence: CTG
caggtctcagccatcatgcc

SEQ ID NO: 35760 - DNA, 20 bp, Artificial Sequence
  Description of Artificial Sequence: Synthetic oligonucleotide
  Target: FXN; (+) strand; PAM type: YTN; PAM sequence: CTC
agccatcatgccagggaaaa

SEQ ID NO: 35761 - DNA, 20 bp, Artificial Sequence
  Description of Artificial Sequence: Synthetic oligonucleotide
  Target: FXN; (+) strand; PAM type: YTN; PAM sequence: CTC
cattcaccactcctcagctt

SEQ ID NO: 35762 - DNA, 20 bp, Artificial Sequence
  Description of Artificial Sequence: Synthetic oligonucleotide
  Target: FXN; (+) strand; PAM type: YTN; PAM sequence: TTC
accactcctcagcttctgct

SEQ ID NO: 35763 - DNA, 20 bp, Artificial Sequence
  Description of Artificial Sequence: Synthetic oligonucleotide
  Target: FXN; (+) strand; PAM type: YTN; PAM sequence: CTC
ctcagcttctgcttctggtt

SEQ ID NO: 35764 - DNA, 20 bp, Artificial Sequence
  Description of Artificial Sequence: Synthetic oligonucleotide
  Target: FXN; (+) strand; PAM type: YTN; PAM sequence: CTC
agcttctgcttctggtttca

SEQ ID NO: 35765 - DNA, 20 bp, Artificial Sequence
  Description of Artificial Sequence: Synthetic oligonucleotide
  Target: FXN; (+) strand; PAM type: YTN; PAM sequence: CTT
ctgcttctggtttcagaggt

SEQ ID NO: 35766 - DNA, 20 bp, Artificial Sequence
  Description of Artificial Sequence: Synthetic oligonucleotide
  Target: FXN; (+) strand; PAM type: YTN; PAM sequence: TTC
tgcttctggtttcagaggtc

SEQ ID NO: 35767 - DNA, 20 bp, Artificial Sequence
  Description of Artificial Sequence: Synthetic oligonucleotide
  Target: FXN; (+) strand; PAM type: YTN; PAM sequence: CTG
cttctggtttcagaggtctc

SEQ ID NO: 35768 - DNA, 20 bp, Artificial Sequence
  Description of Artificial Sequence: Synthetic oligonucleotide
  Target: FXN; (+) strand; PAM type: YTN; PAM sequence: CTT
ctggtttcagaggtctctgt

SEQ ID NO: 35769 - DNA, 20 bp, Artificial Sequence
  Description of Artificial Sequence: Synthetic oligonucleotide
  Target: FXN; (+) strand; PAM type: YTN; PAM sequence: TTC
tggtttcagaggtctctgta

SEQ ID NO: 35770 - DNA, 20 bp, Artificial Sequence
  Description of Artificial Sequence: Synthetic oligonucleotide
  Target: FXN; (+) strand; PAM type: YTN; PAM sequence: CTG
gtttcagaggtctctgtatt

SEQ ID NO: 35771 - DNA, 20 bp, Artificial Sequence
  Description of Artificial Sequence: Synthetic oligonucleotide
  Target: FXN; (+) strand; PAM type: YTN; PAM sequence: TTT
cagaggtctctgtattggag

SEQ ID NO: 35772 - DNA, 20 bp, Artificial Sequence
  Description of Artificial Sequence: Synthetic oligonucleotide
  Target: FXN; (+) strand; PAM type: YTN; PAM sequence: TTC
agaggtctctgtattggagg

SEQ ID NO: 35773 - DNA, 20 bp, Artificial Sequence
  Description of Artificial Sequence: Synthetic oligonucleotide
  Target: FXN; (+) strand; PAM type: YTN; PAM sequence: CTC
tgtattggaggggctttaaa

SEQ ID NO: 35774 - DNA, 20 bp, Artificial Sequence
  Description of Artificial Sequence: Synthetic oligonucleotide
  Target: FXN; (+) strand; PAM type: YTN; PAM sequence: CTG
tattggaggggctttaaagc

SEQ ID NO: 35775 - DNA, 20 bp, Artificial Sequence
  Description of Artificial Sequence: Synthetic oligonucleotide
  Target: FXN; (+) strand; PAM type: YTN; PAM sequence: TTG
gaggggctttaaagcaagaa

SEQ ID NO: 35776 - DNA, 20 bp, Artificial Sequence
  Description of Artificial Sequence: Synthetic oligonucleotide
  Target: FXN; (+) strand; PAM type: YTN; PAM sequence: CTT
taaagcaagaagggtcttta

SEQ ID NO: 35777 - DNA, 20 bp, Artificial Sequence
  Description of Artificial Sequence: Synthetic oligonucleotide
  Target: FXN; (+) strand; PAM type: YTN; PAM sequence: TTT
aaagcaagaagggtctttac

SEQ ID NO: 35778 - DNA, 20 bp, Artificial Sequence
  Description of Artificial Sequence: Synthetic oligonucleotide
  Target: FXN; (+) strand; PAM type: YTN; PAM sequence: TTA
aagcaagaagggtctttacc

SEQ ID NO: 35779 - DNA, 20 bp, Artificial Sequence
  Description of Artificial Sequence: Synthetic oligonucleotide
  Target: FXN; (+) strand; PAM type: YTN; PAM sequence: CTT
tacccacttactcttattca

SEQ ID NO: 35780 - DNA, 20 bp, Artificial Sequence
  Description of Artificial Sequence: Synthetic oligonucleotide
  Target: FXN; (+) strand; PAM type: YTN; PAM sequence: TTT
acccacttactcttattcac

SEQ ID NO: 35781 - DNA, 20 bp, Artificial Sequence
  Description of Artificial Sequence: Synthetic oligonucleotide
  Target: FXN; (+) strand; PAM type: YTN; PAM sequence: TTA
cccacttactcttattcaca

SEQ ID NO: 35782 - DNA, 20 bp, Artificial Sequence
  Description of Artificial Sequence: Synthetic oligonucleotide
  Target: FXN; (+) strand; PAM type: YTN; PAM sequence: CTT
actcttattcacagatgtga

SEQ ID NO: 35783 - DNA, 20 bp, Artificial Sequence
  Description of Artificial Sequence: Synthetic oligonucleotide
  Target: FXN; (+) strand; PAM type: YTN; PAM sequence: TTA
ctcttattcacagatgtgaa

SEQ ID NO: 35784 - DNA, 20 bp, Artificial Sequence
  Description of Artificial Sequence: Synthetic oligonucleotide
  Target: FXN; (+) strand; PAM type: YTN; PAM sequence: CTC
ttattcacagatgtgaatat

SEQ ID NO: 35785 - DNA, 20 bp, Artificial Sequence
  Description of Artificial Sequence: Synthetic oligonucleotide
  Target: FXN; (+) strand; PAM type: YTN; PAM sequence: CTT
attcacagatgtgaatatgc

SEQ ID NO: 35786 - DNA, 20 bp, Artificial Sequence
  Description of Artificial Sequence: Synthetic oligonucleotide
  Target: FXN; (+) strand; PAM type: YTN; PAM sequence: TTA
ttcacagatgtgaatatgca

SEQ ID NO: 35787 - DNA, 20 bp, Artificial Sequence
  Description of Artificial Sequence: Synthetic oligonucleotide
  Target: FXN; (+) strand; PAM type: YTN; PAM sequence: TTC
acagatgtgaatatgcaggt

SEQ ID NO: 35788 - DNA, 20 bp, Artificial Sequence
  Description of Artificial Sequence: Synthetic oligonucleotide
  Target: FXN; (+) strand; PAM type: YTN; PAM sequence: CTA
agtcagaatagagtcaacaa

SEQ ID NO: 35789 - DNA, 20 bp, Artificial Sequence
  Description of Artificial Sequence: Synthetic oligonucleotide
  Target: FXN; (+) strand; PAM type: YTN; PAM sequence: CTT
agcctctagtgtataatggg

SEQ ID NO: 35790 - DNA, 20 bp, Artificial Sequence
  Description of Artificial Sequence: Synthetic oligonucleotide
  Target: FXN; (+) strand; PAM type: YTN; PAM sequence: TTA
gcctctagtgtataatgggc

SEQ ID NO: 35791 - DNA, 20 bp, Artificial Sequence
  Description of Artificial Sequence: Synthetic oligonucleotide
  Target: FXN; (+) strand; PAM type: YTN; PAM sequence: CTC
tagtgtataatgggcattga

SEQ ID NO: 35792 - DNA, 20 bp, Artificial Sequence
  Description of Artificial Sequence: Synthetic oligonucleotide
  Target: FXN; (+) strand; PAM type: YTN; PAM sequence: CTA
gtgtataatgggcattgatg

SEQ ID NO: 35793 - DNA, 20 bp, Artificial Sequence
  Description of Artificial Sequence: Synthetic oligonucleotide
  Target: FXN; (+) strand; PAM type: YTN; PAM sequence: TTG
atgagctactggaaatacag

SEQ ID NO: 35794 - DNA, 20 bp, Artificial Sequence
  Description of Artificial Sequence: Synthetic oligonucleotide
  Target: FXN; (+) strand; PAM type: YTN; PAM sequence: CTA
ctggaaatacagagatgaag

SEQ ID NO: 35795 - DNA, 20 bp, Artificial Sequence
  Description of Artificial Sequence: Synthetic oligonucleotide
  Target: FXN; (+) strand; PAM type: YTN; PAM sequence: CTG
gaaatacagagatgaagaaa

SEQ ID NO: 35796 - DNA, 20 bp, Artificial Sequence
  Description of Artificial Sequence: Synthetic oligonucleotide
  Target: FXN; (+) strand; PAM type: YTN; PAM sequence: CTT
caaggagctcaatctagcaa

SEQ ID NO: 35797 - DNA, 20 bp, Artificial Sequence
  Description of Artificial Sequence: Synthetic oligonucleotide
  Target: FXN; (+) strand; PAM type: YTN; PAM sequence: TTC
aaggagctcaatctagcaag

SEQ ID NO: 35798 - DNA, 20 bp, Artificial Sequence
  Description of Artificial Sequence: Synthetic oligonucleotide
  Target: FXN; (+) strand; PAM type: YTN; PAM sequence: CTC
aatctagcaagggagacaga

SEQ ID NO: 35799 - DNA, 20 bp, Artificial Sequence
  Description of Artificial Sequence: Synthetic oligonucleotide
  Target: FXN; (+) strand; PAM type: YTN; PAM sequence: CTA
gcaagggagacagactcttt

SEQ ID NO: 35800 - DNA, 20 bp, Artificial Sequence
  Description of Artificial Sequence: Synthetic oligonucleotide
  Target: FXN; (+) strand; PAM type: YTN; PAM sequence: CTC
tttgtaggtgggaccgggct

SEQ ID NO: 35801 - DNA, 20 bp, Artificial Sequence
  Description of Artificial Sequence: Synthetic oligonucleotide
  Target: FXN; (+) strand; PAM type: YTN; PAM sequence: CTT
tgtaggtgggaccgggcttc

SEQ ID NO: 35802 - DNA, 20 bp, Artificial Sequence
  Description of Artificial Sequence: Synthetic oligonucleotide
  Target: FXN; (+) strand; PAM type: YTN; PAM sequence: TTT
gtaggtgggaccgggcttcc

SEQ ID NO: 35803 - DNA, 20 bp, Artificial Sequence
  Description of Artificial Sequence: Synthetic oligonucleotide
  Target: FXN; (+) strand; PAM type: YTN; PAM sequence: TTG
taggtgggaccgggcttccc

SEQ ID NO: 35804 - DNA, 20 bp, Artificial Sequence
  Description of Artificial Sequence: Synthetic oligonucleotide
  Target: FXN; (+) strand; PAM type: YTN; PAM sequence: CTT
ccctgcagcagaaggaagct

SEQ ID NO: 35805 - DNA, 20 bp, Artificial Sequence
  Description of Artificial Sequence: Synthetic oligonucleotide
  Target: FXN; (+) strand; PAM type: YTN; PAM sequence: TTC
cctgcagcagaaggaagctt

SEQ ID NO: 35806 - DNA, 20 bp, Artificial Sequence
  Description of Artificial Sequence: Synthetic oligonucleotide
  Target: FXN; (+) strand; PAM type: YTN; PAM sequence: CTG
cagcagaaggaagcttgaaa

SEQ ID NO: 35807 - DNA, 20 bp, Artificial Sequence
  Description of Artificial Sequence: Synthetic oligonucleotide
  Target: FXN; (+) strand; PAM type: YTN; PAM sequence: CTT
gaaattggtaacgagcctca

SEQ ID NO: 35808 - DNA, 20 bp, Artificial Sequence
  Description of Artificial Sequence: Synthetic oligonucleotide
  Target: FXN; (+) strand; PAM type: YTN; PAM sequence: TTG
aaattggtaacgagcctcag

SEQ ID NO: 35809 - DNA, 20 bp, Artificial Sequence
  Description of Artificial Sequence: Synthetic oligonucleotide
  Target: FXN; (+) strand; PAM type: YTN; PAM sequence: TTG
gtaacgagcctcagaaggga

SEQ ID NO: 35810 - DNA, 20 bp, Artificial Sequence
  Description of Artificial Sequence: Synthetic oligonucleotide
  Target: FXN; (+) strand; PAM type: YTN; PAM sequence: CTC
agaagggacagaggcaggcc

SEQ ID NO: 35811 - DNA, 20 bp, Artificial Sequence
  Description of Artificial Sequence: Synthetic oligonucleotide
  Target: FXN; (+) strand; PAM type: YTN; PAM sequence: CTA
ccctgagaggatcgcatgtg

SEQ ID NO: 35812 - DNA, 20 bp, Artificial Sequence
  Description of Artificial Sequence: Synthetic oligonucleotide
  Target: FXN; (+) strand; PAM type: YTN; PAM sequence: CTG
agaggatcgcatgtggacac

SEQ ID NO: 35813 - DNA, 20 bp, Artificial Sequence
  Description of Artificial Sequence: Synthetic oligonucleotide
  Target: FXN; (+) strand; PAM type: YTN; PAM sequence: CTA
tgacctggccctgctttgac

SEQ ID NO: 35814 - DNA, 20 bp, Artificial Sequence
  Description of Artificial Sequence: Synthetic oligonucleotide
  Target: FXN; (+) strand; PAM type: YTN; PAM sequence: CTG
gccctgctttgacccactag

SEQ ID NO: 35815 - DNA, 20 bp, Artificial Sequence
  Description of Artificial Sequence: Synthetic oligonucleotide
  Target: FXN; (+) strand; PAM type: YTN; PAM sequence: CTG
ctttgacccactagctgtgc

SEQ ID NO: 35816 - DNA, 20 bp, Artificial Sequence
  Description of Artificial Sequence: Synthetic oligonucleotide
  Target: FXN; (+) strand; PAM type: YTN; PAM sequence: CTT
tgacccactagctgtgctgt

SEQ ID NO: 35817 - DNA, 20 bp, Artificial Sequence
  Description of Artificial Sequence: Synthetic oligonucleotide
  Target: FXN; (+) strand; PAM type: YTN; PAM sequence: TTT
gacccactagctgtgctgta

SEQ ID NO: 35818 - DNA, 20 bp, Artificial Sequence
  Description of Artificial Sequence: Synthetic oligonucleotide
  Target: FXN; (+) strand; PAM type: YTN; PAM sequence: TTG
acccactagctgtgctgtag

SEQ ID NO: 35819 - DNA, 20 bp, Artificial Sequence
  Description of Artificial Sequence: Synthetic oligonucleotide
  Target: FXN; (+) strand; PAM type: YTN; PAM sequence: CTA
gctgtgctgtagggccaggt

SEQ ID NO: 35820 - DNA, 20 bp, Artificial Sequence
  Description of Artificial Sequence: Synthetic oligonucleotide
  Target: FXN; (+) strand; PAM type: YTN; PAM sequence: CTG
tgctgtagggccaggtggag

SEQ ID NO: 35821 - DNA, 20 bp, Artificial Sequence
  Description of Artificial Sequence: Synthetic oligonucleotide
  Target: FXN; (+) strand; PAM type: YTN; PAM sequence: CTG
tagggccaggtggagcctgg

SEQ ID NO: 35822 - DNA, 20 bp, Artificial Sequence
  Description of Artificial Sequence: Synthetic oligonucleotide
  Target: FXN; (+) strand; PAM type: YTN; PAM sequence: CTG
gagtggcctgtgctaagggg

SEQ ID NO: 35823 - DNA, 20 bp, Artificial Sequence
  Description of Artificial Sequence: Synthetic oligonucleotide
  Target: FXN; (+) strand; PAM type: YTN; PAM sequence: CTG
tgctaaggggctactatgag

SEQ ID NO: 35824 - DNA, 20 bp, Artificial Sequence
  Description of Artificial Sequence: Synthetic oligonucleotide
  Target: FXN; (+) strand; PAM type: YTN; PAM sequence: CTA
aggggctactatgagctctt

SEQ ID NO: 35825 - DNA, 20 bp, Artificial Sequence
  Description of Artificial Sequence: Synthetic oligonucleotide
  Target: FXN; (+) strand; PAM type: YTN; PAM sequence: CTA
ctatgagctctttccactcc

SEQ ID NO: 35826 - DNA, 20 bp, Artificial Sequence
  Description of Artificial Sequence: Synthetic oligonucleotide
  Target: FXN; (+) strand; PAM type: YTN; PAM sequence: CTA
tgagctctttccactccccc

SEQ ID NO: 35827 - DNA, 20 bp, Artificial Sequence
  Description of Artificial Sequence: Synthetic oligonucleotide
  Target: FXN; (+) strand; PAM type: YTN; PAM sequence: CTC
tttccactcccccaaggcat

SEQ ID NO: 35828 - DNA, 20 bp, Artificial Sequence
  Description of Artificial Sequence: Synthetic oligonucleotide
  Target: FXN; (+) strand; PAM type: YTN; PAM sequence: CTT
tccactcccccaaggcattg

SEQ ID NO: 35829 - DNA, 20 bp, Artificial Sequence
  Description of Artificial Sequence: Synthetic oligonucleotide
  Target: FXN; (+) strand; PAM type: YTN; PAM sequence: TTT
ccactcccccaaggcattgc

SEQ ID NO: 35830 - DNA, 20 bp, Artificial Sequence
  Description of Artificial Sequence: Synthetic oligonucleotide
  Target: FXN; (+) strand; PAM type: YTN; PAM sequence: TTC
cactcccccaaggcattgca

SEQ ID NO: 35831 - DNA, 20 bp, Artificial Sequence
  Description of Artificial Sequence: Synthetic oligonucleotide
  Target: FXN; (+) strand; PAM type: YTN; PAM sequence: CTC
ccccaaggcattgcataaat

SEQ ID NO: 35832 - DNA, 20 bp, Artificial Sequence
  Description of Artificial Sequence: Synthetic oligonucleotide
  Target: FXN; (+) strand; PAM type: YTN; PAM sequence: TTG
cataaataatgtcactttct

SEQ ID NO: 35833 - DNA, 20 bp, Artificial Sequence
  Description of Artificial Sequence: Synthetic oligonucleotide
  Target: FXN; (+) strand; PAM type: YTN; PAM sequence: CTT
tctgtttgcacagcaaaatc

SEQ ID NO: 35834 - DNA, 20 bp, Artificial Sequence
  Description of Artificial Sequence: Synthetic oligonucleotide
  Target: FXN; (+) strand; PAM type: YTN; PAM sequence: TTT
ctgtttgcacagcaaaatca

SEQ ID NO: 35835 - DNA, 20 bp, Artificial Sequence
  Description of Artificial Sequence: Synthetic oligonucleotide
  Target: FXN; (+) strand; PAM type: YTN; PAM sequence: TTC
tgtttgcacagcaaaatcag

SEQ ID NO: 35836 - DNA, 20 bp, Artificial Sequence
  Description of Artificial Sequence: Synthetic oligonucleotide
  Target: FXN; (+) strand; PAM type: YTN; PAM sequence: CTG
tttgcacagcaaaatcaggg

SEQ ID NO: 35837 - DNA, 20 bp, Artificial Sequence
  Description of Artificial Sequence: Synthetic oligonucleotide
  Target: FXN; (+) strand; PAM type: YTN; PAM sequence: TTT
gcacagcaaaatcagggaca

SEQ ID NO: 35838 - DNA, 20 bp, Artificial Sequence
  Description of Artificial Sequence: Synthetic oligonucleotide
  Target: FXN; (+) strand; PAM type: YTN; PAM sequence: TTG
cacagcaaaatcagggacac

SEQ ID NO: 35839 - DNA, 20 bp, Artificial Sequence
  Description of Artificial Sequence: Synthetic oligonucleotide
  Target: FXN; (+) strand; PAM type: YTN; PAM sequence: TTT
tctagaacatggggtgcctc

SEQ ID NO: 35840 - DNA, 20 bp, Artificial Sequence
  Description of Artificial Sequence: Synthetic oligonucleotide
  Target: FXN; (+) strand; PAM type: YTN; PAM sequence: TTT
ctagaacatggggtgcctcc

SEQ ID NO: 35841 - DNA, 20 bp, Artificial Sequence
  Description of Artificial Sequence: Synthetic oligonucleotide
  Target: FXN; (+) strand; PAM type: YTN; PAM sequence: TTC
tagaacatggggtgcctccc

SEQ ID NO: 35842 - DNA, 20 bp, Artificial Sequence
  Description of Artificial Sequence: Synthetic oligonucleotide
  Target: FXN; (+) strand; PAM type: YTN; PAM sequence: CTA
gaacatggggtgcctcccct

SEQ ID NO: 35843 - DNA, 20 bp, Artificial Sequence
  Description of Artificial Sequence: Synthetic oligonucleotide
  Target: FXN; (+) strand; PAM type: YTN; PAM sequence: CTC
ccctccccccagcccaacag

SEQ ID NO: 35844 - DNA, 20 bp, Artificial Sequence
  Description of Artificial Sequence: Synthetic oligonucleotide
  Target: FXN; (+) strand; PAM type: YTN; PAM sequence: CTC
cccccagcccaacagaagtt

SEQ ID NO: 35845 - DNA, 20 bp, Artificial Sequence
  Description of Artificial Sequence: Synthetic oligonucleotide
  Target: FXN; (+) strand; PAM type: YTN; PAM sequence: TTC
tacaatgactgatgggccct

SEQ ID NO: 35846 - DNA, 20 bp, Artificial Sequence
  Description of Artificial Sequence: Synthetic oligonucleotide
  Target: FXN; (+) strand; PAM type: YTN; PAM sequence: CTA
caatgactgatgggcccttg

SEQ ID NO: 35847 - DNA, 20 bp, Artificial Sequence
  Description of Artificial Sequence: Synthetic oligonucleotide
  Target: FXN; (+) strand; PAM type: YTN; PAM sequence: CTG
atgggcccttgtttttgttt

SEQ ID NO: 35848 - DNA, 20 bp, Artificial Sequence
  Description of Artificial Sequence: Synthetic oligonucleotide
  Target: FXN; (+) strand; PAM type: YTN; PAM sequence: CTT
gtttttgtttgagacggaac

SEQ ID NO: 35849 - DNA, 20 bp, Artificial Sequence
  Description of Artificial Sequence: Synthetic oligonucleotide
  Target: FXN; (+) strand; PAM type: YTN; PAM sequence: TTG
tttttgtttgagacggaaca

SEQ ID NO: 35850 - DNA, 20 bp, Artificial Sequence
  Description of Artificial Sequence: Synthetic oligonucleotide
  Target: FXN; (+) strand; PAM type: YTN; PAM sequence: TTT
ttgtttgagacggaacaccc

SEQ ID NO: 35851 - DNA, 20 bp, Artificial Sequence
  Description of Artificial Sequence: Synthetic oligonucleotide
  Target: FXN; (+) strand; PAM type: YTN; PAM sequence: TTT
tgtttgagacggaacacccc

SEQ ID NO: 35852 - DNA, 20 bp, Artificial Sequence
  Description of Artificial Sequence: Synthetic oligonucleotide
  Target: FXN; (+) strand; PAM type: YTN; PAM sequence: TTT
gtttgagacggaacacccca

SEQ ID NO: 35853 - DNA, 20 bp, Artificial Sequence
  Description of Artificial Sequence: Synthetic oligonucleotide
  Target: FXN; (+) strand; PAM type: YTN; PAM sequence: TTG
tttgagacggaacaccccac

SEQ ID NO: 35854 - DNA, 20 bp, Artificial Sequence
  Description of Artificial Sequence: Synthetic oligonucleotide
  Target: FXN; (+) strand; PAM type: YTN; PAM sequence: TTT
gagacggaacaccccacagg

SEQ ID NO: 35855 - DNA, 20 bp, Artificial Sequence
  Description of Artificial Sequence: Synthetic oligonucleotide
  Target: FXN; (+) strand; PAM type: YTN; PAM sequence: TTG
agacggaacaccccacaggg

SEQ ID NO: 35856 - DNA, 20 bp, Artificial Sequence
  Description of Artificial Sequence: Synthetic oligonucleotide
  Target: FXN; (+) strand; PAM type: YTN; PAM sequence: TTC
cgagtggtgatttgtggccc

SEQ ID NO: 35857 - DNA, 20 bp, Artificial Sequence
  Description of Artificial Sequence: Synthetic oligonucleotide
  Target: FXN; (+) strand; PAM type: YTN; PAM sequence: TTT
gtggcccacaggccactggc

SEQ ID NO: 35858 - DNA, 20 bp, Artificial Sequence
  Description of Artificial Sequence: Synthetic oligonucleotide
  Target: FXN; (+) strand; PAM type: YTN; PAM sequence: TTG
tggcccacaggccactggca

SEQ ID NO: 35859 - DNA, 20 bp, Artificial Sequence
  Description of Artificial Sequence: Synthetic oligonucleotide
  Target: FXN; (+) strand; PAM type: YTN; PAM sequence: CTG
gcaagtggaggcagagctgc

SEQ ID NO: 35860 - DNA, 20 bp, Artificial Sequence
  Description of Artificial Sequence: Synthetic oligonucleotide
  Target: FXN; (+) strand; PAM type: YTN; PAM sequence: CTG
cagagccctcgggagccaca

SEQ ID NO: 35861 - DNA, 20 bp, Artificial Sequence
  Description of Artificial Sequence: Synthetic oligonucleotide
  Target: FXN; (+) strand; PAM type: YTN; PAM sequence: CTC
gggagccacagagggcctgc

SEQ ID NO: 35862 - DNA, 20 bp, Artificial Sequence
  Description of Artificial Sequence: Synthetic oligonucleotide
  Target: FXN; (+) strand; PAM type: YTN; PAM sequence: CTG
ctggccgccacgacatgcca

SEQ ID NO: 35863 - DNA, 20 bp, Artificial Sequence
  Description of Artificial Sequence: Synthetic oligonucleotide
  Target: FXN; (+) strand; PAM type: YTN; PAM sequence: CTG
gccgccacgacatgccaact

SEQ ID NO: 35864 - DNA, 20 bp, Artificial Sequence
  Description of Artificial Sequence: Synthetic oligonucleotide
  Target: FXN; (+) strand; PAM type: YTN; PAM sequence: CTC
agctgctgctggccctcctg

SEQ ID NO: 35865 - DNA, 20 bp, Artificial Sequence
  Description of Artificial Sequence: Synthetic oligonucleotide
  Target: FXN; (+) strand; PAM type: YTN; PAM sequence: CTG
ctgctggccctcctgtgggc

SEQ ID NO: 35866 - DNA, 20 bp, Artificial Sequence
  Description of Artificial Sequence: Synthetic oligonucleotide
  Target: FXN; (+) strand; PAM type: YTN; PAM sequence: CTG
ctggccctcctgtgggcggc

SEQ ID NO: 35867 - DNA, 20 bp, Artificial Sequence
  Description of Artificial Sequence: Synthetic oligonucleotide
  Target: FXN; (+) strand; PAM type: YTN; PAM sequence: CTG
gccctcctgtgggcggcagt

SEQ ID NO: 35868 - DNA, 20 bp, Artificial Sequence
  Description of Artificial Sequence: Synthetic oligonucleotide
  Target: FXN; (+) strand; PAM type: YTN; PAM sequence: CTC
ctgtgggcggcagtgctagt

SEQ ID NO: 35869 - DNA, 20 bp, Artificial Sequence
  Description of Artificial Sequence: Synthetic oligonucleotide
  Target: FXN; (+) strand; PAM type: YTN; PAM sequence: CTG
tgggcggcagtgctagtgat

SEQ ID NO: 35870 - DNA, 20 bp, Artificial Sequence
  Description of Artificial Sequence: Synthetic oligonucleotide
  Target: FXN; (+) strand; PAM type: YTN; PAM sequence: CTA
gtgatgtgcagaatcttagg

SEQ ID NO: 35871 - DNA, 20 bp, Artificial Sequence
  Description of Artificial Sequence: Synthetic oligonucleotide
  Target: FXN; (+) strand; PAM type: YTN; PAM sequence: CTT
aggactagtgccaaggaacc

SEQ ID NO: 35872 - DNA, 20 bp, Artificial Sequence
  Description of Artificial Sequence: Synthetic oligonucleotide
  Target: FXN; (+) strand; PAM type: YTN; PAM sequence: TTA
ggactagtgccaaggaacct

SEQ ID NO: 35873 - DNA, 20 bp, Artificial Sequence
  Description of Artificial Sequence: Synthetic oligonucleotide
  Target: FXN; (+) strand; PAM type: YTN; PAM sequence: CTA
gtgccaaggaacctataaat

SEQ ID NO: 35874 - DNA, 20 bp, Artificial Sequence
  Description of Artificial Sequence: Synthetic oligonucleotide
  Target: FXN; (+) strand; PAM type: YTN; PAM sequence: CTA
taaataccctgggtgaccca

SEQ ID NO: 35875 - DNA, 20 bp, Artificial Sequence
  Description of Artificial Sequence: Synthetic oligonucleotide
  Target: FXN; (+) strand; PAM type: YTN; PAM sequence: CTG
ggtgacccaggcgtgcactg

SEQ ID NO: 35876 - DNA, 20 bp, Artificial Sequence
  Description of Artificial Sequence: Synthetic oligonucleotide
  Target: FXN; (+) strand; PAM type: YTN; PAM sequence: CTG
ctgtggtggccttcacagtc

SEQ ID NO: 35877 - DNA, 20 bp, Artificial Sequence
  Description of Artificial Sequence: Synthetic oligonucleotide
  Target: FXN; (+) strand; PAM type: YTN; PAM sequence: CTG
tggtggccttcacagtcaga

SEQ ID NO: 35878 - DNA, 20 bp, Artificial Sequence
  Description of Artificial Sequence: Synthetic oligonucleotide
  Target: FXN; (+) strand; PAM type: YTN; PAM sequence: CTT
cacagtcagaagatgacaag

SEQ ID NO: 35879 - DNA, 20 bp, Artificial Sequence
  Description of Artificial Sequence: Synthetic oligonucleotide
  Target: FXN; (+) strand; PAM type: YTN; PAM sequence: TTC
acagtcagaagatgacaagc

SEQ ID NO: 35880 - DNA, 20 bp, Artificial Sequence
  Description of Artificial Sequence: Synthetic oligonucleotide
  Target: FXN; (+) strand; PAM type: YTN; PAM sequence: CTG
agaaggggagaatcggccca

SEQ ID NO: 35881 - DNA, 20 bp, Artificial Sequence
  Description of Artificial Sequence: Synthetic oligonucleotide
  Target: FXN; (+) strand; PAM type: YTN; PAM sequence: CTC
aggctggtggtggtcttacg

SEQ ID NO: 35882 - DNA, 20 bp, Artificial Sequence
  Description of Artificial Sequence: Synthetic oligonucleotide
  Target: FXN; (+) strand; PAM type: YTN; PAM sequence: CTG
gtggtggtcttacgttgacc

SEQ ID NO: 35883 - DNA, 20 bp, Artificial Sequence
  Description of Artificial Sequence: Synthetic oligonucleotide
  Target: FXN; (+) strand; PAM type: YTN; PAM sequence: CTT
acgttgaccatgccagaggc

SEQ ID NO: 35884 - DNA, 20 bp, Artificial Sequence
  Description of Artificial Sequence: Synthetic oligonucleotide
  Target: FXN; (+) strand; PAM type: YTN; PAM sequence: TTA
cgttgaccatgccagaggcc

SEQ ID NO: 35885 - DNA, 20 bp, Artificial Sequence
  Description of Artificial Sequence: Synthetic oligonucleotide
  Target: FXN; (+) strand; PAM type: YTN; PAM sequence: TTG
accatgccagaggccagtcc

SEQ ID NO: 35886 - DNA, 20 bp, Artificial Sequence
  Description of Artificial Sequence: Synthetic oligonucleotide
  Target: FXN; (+) strand; PAM type: YTN; PAM sequence: CTT
gattgctccaaaccctctgt

SEQ ID NO: 35887 - DNA, 20 bp, Artificial Sequence
  Description of Artificial Sequence: Synthetic oligonucleotide
  Target: FXN; (+) strand; PAM type: YTN; PAM sequence: TTG
attgctccaaaccctctgtt

SEQ ID NO: 35888 - DNA, 20 bp, Artificial Sequence
  Description of Artificial Sequence: Synthetic oligonucleotide
  Target: FXN; (+) strand; PAM type: YTN; PAM sequence: TTG
ctccaaaccctctgttcgag

SEQ ID NO: 35889 - DNA, 20 bp, Artificial Sequence
  Description of Artificial Sequence: Synthetic oligonucleotide
  Target: FXN; (+) strand; PAM type: YTN; PAM sequence: CTC
caaaccctctgttcgagggt

SEQ ID NO: 35890 - DNA, 20 bp, Artificial Sequence
  Description of Artificial Sequence: Synthetic oligonucleotide
  Target: FXN; (+) strand; PAM type: YTN; PAM sequence: CTC
tgttcgagggttccaaatga

SEQ ID NO: 35891 - DNA, 20 bp, Artificial Sequence
  Description of Artificial Sequence: Synthetic oligonucleotide
  Target: FXN; (+) strand; PAM type: YTN; PAM sequence: CTG
ttcgagggttccaaatgaaa

SEQ ID NO: 35892 - DNA, 20 bp, Artificial Sequence
  Description of Artificial Sequence: Synthetic oligonucleotide
  Target: FXN; (+) strand; PAM type: YTN; PAM sequence: TTC
gagggttccaaatgaaatga

SEQ ID NO: 35893 - DNA, 20 bp, Artificial Sequence
  Description of Artificial Sequence: Synthetic oligonucleotide
  Target: FXN; (+) strand; PAM type: YTN; PAM sequence: TTC
caaatgaaatgagcaggtcc

SEQ ID NO: 35894 - DNA, 20 bp, Artificial Sequence
  Description of Artificial Sequence: Synthetic oligonucleotide
  Target: FXN; (+) strand; PAM type: YTN; PAM sequence: CTC
gtgtcaggacctaggttagt

SEQ ID NO: 35895 - DNA, 20 bp, Artificial Sequence
  Description of Artificial Sequence: Synthetic oligonucleotide
  Target: FXN; (+) strand; PAM type: YTN; PAM sequence: CTA
ggttagtttctgaaaaagca

SEQ ID NO: 35896 - DNA, 20 bp, Artificial Sequence
  Description of Artificial Sequence: Synthetic oligonucleotide
  Target: FXN; (+) strand; PAM type: YTN; PAM sequence: TTA
gtttctgaaaaagcatgaaa

SEQ ID NO: 35897 - DNA, 20 bp, Artificial Sequence
  Description of Artificial Sequence: Synthetic oligonucleotide
  Target: FXN; (+) strand; PAM type: YTN; PAM sequence: TTT
ctgaaaaagcatgaaaagca

SEQ ID NO: 35898 - DNA, 20 bp, Artificial Sequence
  Description of Artificial Sequence: Synthetic oligonucleotide
  Target: FXN; (+) strand; PAM type: YTN; PAM sequence: TTC
tgaaaaagcatgaaaagcag

SEQ ID NO: 35899 - DNA, 20 bp, Artificial Sequence
  Description of Artificial Sequence: Synthetic oligonucleotide
  Target: FXN; (+) strand; PAM type: YTN; PAM sequence: CTG
aaaaagcatgaaaagcaggc

SEQ ID NO: 35900 - DNA, 20 bp, Artificial Sequence
  Description of Artificial Sequence: Synthetic oligonucleotide
  Target: FXN; (+) strand; PAM type: YTN; PAM sequence: CTC
ctgaacttccccgagtgact

SEQ ID NO: 35901 - DNA, 20 bp, Artificial Sequence
  Description of Artificial Sequence: Synthetic oligonucleotide
  Target: FXN; (+) strand; PAM type: YTN; PAM sequence: CTG
aacttccccgagtgactgat

SEQ ID NO: 35902 - DNA, 20 bp, Artificial Sequence
  Description of Artificial Sequence: Synthetic oligonucleotide
  Target: FXN; (+) strand; PAM type: YTN; PAM sequence: CTT
ccccgagtgactgatgcaaa

SEQ ID NO: 35903 - DNA, 20 bp, Artificial Sequence
  Description of Artificial Sequence: Synthetic oligonucleotide
  Target: FXN; (+) strand; PAM type: YTN; PAM sequence: TTC
cccgagtgactgatgcaaag

SEQ ID NO: 35904 - DNA, 20 bp, Artificial Sequence
  Description of Artificial Sequence: Synthetic oligonucleotide
  Target: FXN; (+) strand; PAM type: YTN; PAM sequence: CTG
atgcaaagtgcgtcctgcat

SEQ ID NO: 35905 - DNA, 20 bp, Artificial Sequence
  Description of Artificial Sequence: Synthetic oligonucleotide
  Target: FXN; (+) strand; PAM type: YTN; PAM sequence: CTG
catgcttcacagcaccatgg

SEQ ID NO: 35906 - DNA, 20 bp, Artificial Sequence
  Description of Artificial Sequence: Synthetic oligonucleotide
  Target: FXN; (+) strand; PAM type: YTN; PAM sequence: CTT
cacagcaccatggagaggat

SEQ ID NO: 35907 - DNA, 20 bp, Artificial Sequence
  Description of Artificial Sequence: Synthetic oligonucleotide
  Target: FXN; (+) strand; PAM type: YTN; PAM sequence: TTC
acagcaccatggagaggatc

SEQ ID NO: 35908 - DNA, 20 bp, Artificial Sequence
  Description of Artificial Sequence: Synthetic oligonucleotide
  Target: FXN; (+) strand; PAM type: YTN; PAM sequence: CTT
caggggcaaactgcagacta

SEQ ID NO: 35909 - DNA, 20 bp, Artificial Sequence
  Description of Artificial Sequence: Synthetic oligonucleotide
  Target: FXN; (+) strand; PAM type: YTN; PAM sequence: TTC
aggggcaaactgcagactat

SEQ ID NO: 35910 - DNA, 20 bp, Artificial Sequence
  Description of Artificial Sequence: Synthetic oligonucleotide
  Target: FXN; (+) strand; PAM type: YTN; PAM sequence: CTG
cagactatctgaatgacggc

SEQ ID NO: 35911 - DNA, 20 bp, Artificial Sequence
  Description of Artificial Sequence: Synthetic oligonucleotide
  Target: FXN; (+) strand; PAM type: YTN; PAM sequence: CTA
tctgaatgacggcactgacc

SEQ ID NO: 35912 - DNA, 20 bp, Artificial Sequence
  Description of Artificial Sequence: Synthetic oligonucleotide
  Target: FXN; (+) strand; PAM type: YTN; PAM sequence: CTG
aatgacggcactgaccatca

SEQ ID NO: 35913 - DNA, 20 bp, Artificial Sequence
  Description of Artificial Sequence: Synthetic oligonucleotide
  Target: FXN; (+) strand; PAM type: YTN; PAM sequence: CTG
accatcagcaaaccgcagag

SEQ ID NO: 35914 - DNA, 20 bp, Artificial Sequence
  Description of Artificial Sequence: Synthetic oligonucleotide
  Target: FXN; (+) strand; PAM type: YTN; PAM sequence: CTG
cctgaccaagaaattgcgag

SEQ ID NO: 35915 - DNA, 20 bp, Artificial Sequence
  Description of Artificial Sequence: Synthetic oligonucleotide
  Target: FXN; (+) strand; PAM type: YTN; PAM sequence: CTG
accaagaaattgcgagacag

SEQ ID NO: 35916 - DNA, 20 bp, Artificial Sequence
  Description of Artificial Sequence: Synthetic oligonucleotide
  Target: FXN; (+) strand; PAM type: YTN; PAM sequence: TTG
cgagacagaagcaatgcttg

SEQ ID NO: 35917 - DNA, 20 bp, Artificial Sequence
  Description of Artificial Sequence: Synthetic oligonucleotide
  Target: FXN; (+) strand; PAM type: YTN; PAM sequence: CTT
gcaggcgaagaagaaggggc

SEQ ID NO: 35918 - DNA, 20 bp, Artificial Sequence
  Description of Artificial Sequence: Synthetic oligonucleotide
  Target: FXN; (+) strand; PAM type: YTN; PAM sequence: TTG
caggcgaagaagaaggggcc

SEQ ID NO: 35919 - DNA, 20 bp, Artificial Sequence
  Description of Artificial Sequence: Synthetic oligonucleotide
  Target: FXN; (+) strand; PAM type: YTN; PAM sequence: CTC
acgcctgtaatcccagcact

SEQ ID NO: 35920 - DNA, 20 bp, Artificial Sequence
  Description of Artificial Sequence: Synthetic oligonucleotide
  Target: FXN; (+) strand; PAM type: YTN; PAM sequence: CTG
taatcccagcactttgggag

SEQ ID NO: 35921 - DNA, 20 bp, Artificial Sequence
  Description of Artificial Sequence: Synthetic oligonucleotide
  Target: FXN; (+) strand; PAM type: YTN; PAM sequence: CTT
tgggaggccaaggcaggcgg

SEQ ID NO: 35922 - DNA, 20 bp, Artificial Sequence
  Description of Artificial Sequence: Synthetic oligonucleotide
  Target: FXN; (+) strand; PAM type: YTN; PAM sequence: TTT
gggaggccaaggcaggcgga

SEQ ID NO: 35923 - DNA, 20 bp, Artificial Sequence
  Description of Artificial Sequence: Synthetic oligonucleotide
  Target: FXN; (+) strand; PAM type: YTN; PAM sequence: TTG
ggaggccaaggcaggcggat

SEQ ID NO: 35924 - DNA, 20 bp, Artificial Sequence
  Description of Artificial Sequence: Synthetic oligonucleotide
  Target: FXN; (+) strand; PAM type: YTN; PAM sequence: CTT
gaggtcaggagtttgagacc

SEQ ID NO: 35925 - DNA, 20 bp, Artificial Sequence
  Description of Artificial Sequence: Synthetic oligonucleotide
  Target: FXN; (+) strand; PAM type: YTN; PAM sequence: TTG
aggtcaggagtttgagacca

SEQ ID NO: 35926 - DNA, 20 bp, Artificial Sequence
  Description of Artificial Sequence: Synthetic oligonucleotide
  Target: FXN; (+) strand; PAM type: YTN; PAM sequence: TTT
gagaccagcctgggcaacat

SEQ ID NO: 35927 - DNA, 20 bp, Artificial Sequence
  Description of Artificial Sequence: Synthetic oligonucleotide
  Target: FXN; (+) strand; PAM type: YTN; PAM sequence: TTG
agaccagcctgggcaacata

SEQ ID NO: 35928 - DNA, 20 bp, Artificial Sequence
  Description of Artificial Sequence: Synthetic oligonucleotide
  Target: FXN; (+) strand; PAM type: YTN; PAM sequence: CTG
ggcaacatagtgaaaccctg

SEQ ID NO: 35929 - DNA, 20 bp, Artificial Sequence
  Description of Artificial Sequence: Synthetic oligonucleotide
  Target: FXN; (+) strand; PAM type: YTN; PAM sequence: CTG
tctctactaaaaatacaaaa

SEQ ID NO: 35930 - DNA, 20 bp, Artificial Sequence
  Description of Artificial Sequence: Synthetic oligonucleotide
  Target: FXN; (+) strand; PAM type: YTN; PAM sequence: CTC
tactaaaaatacaaaaaatt

SEQ ID NO: 35931 - DNA, 20 bp, Artificial Sequence
  Description of Artificial Sequence: Synthetic oligonucleotide
  Target: FXN; (+) strand; PAM type: YTN; PAM sequence: CTA
ctaaaaatacaaaaaattcg

SEQ ID NO: 35932 - DNA, 20 bp, Artificial Sequence
  Description of Artificial Sequence: Synthetic oligonucleotide
  Target: FXN; (+) strand; PAM type: YTN; PAM sequence: CTA
aaaatacaaaaaattcgcca

SEQ ID NO: 35933 - DNA, 20 bp, Artificial Sequence
  Description of Artificial Sequence: Synthetic oligonucleotide
  Target: FXN; (+) strand; PAM type: YTN; PAM sequence: TTC
gccaggcatggtggcaggca

SEQ ID NO: 35934 - DNA, 20 bp, Artificial Sequence
  Description of Artificial Sequence: Synthetic oligonucleotide
  Target: FXN; (+) strand; PAM type: YTN; PAM sequence: CTG
taatcccagctgcttgggag

SEQ ID NO: 35935 - DNA, 20 bp, Artificial Sequence
  Description of Artificial Sequence: Synthetic oligonucleotide
  Target: FXN; (+) strand; PAM type: YTN; PAM sequence: CTG
cttgggagactgagacagga

SEQ ID NO: 35936 - DNA, 20 bp, Artificial Sequence
  Description of Artificial Sequence: Synthetic oligonucleotide
  Target: FXN; (+) strand; PAM type: YTN; PAM sequence: CTT
gggagactgagacaggagaa

SEQ ID NO: 35937 - DNA, 20 bp, Artificial Sequence
  Description of Artificial Sequence: Synthetic oligonucleotide
  Target: FXN; (+) strand; PAM type: YTN; PAM sequence: TTG
ggagactgagacaggagaat

SEQ ID NO: 35938 - DNA, 20 bp, Artificial Sequence
  Description of Artificial Sequence: Synthetic oligonucleotide
  Target: FXN; (+) strand; PAM type: YTN; PAM sequence: CTG
agacaggagaattgcttgaa

SEQ ID NO: 35939 - DNA, 20 bp, Artificial Sequence
  Description of Artificial Sequence: Synthetic oligonucleotide
  Target: FXN; (+) strand; PAM type: YTN; PAM sequence: TTG
cttgaacccaggaggcgaag

SEQ ID NO: 35940 - DNA, 20 bp, Artificial Sequence
  Description of Artificial Sequence: Synthetic oligonucleotide
  Target: FXN; (+) strand; PAM type: YTN; PAM sequence: CTT
gaacccaggaggcgaaggtt

SEQ ID NO: 35941 - DNA, 20 bp, Artificial Sequence
  Description of Artificial Sequence: Synthetic oligonucleotide
  Target: FXN; (+) strand; PAM type: YTN; PAM sequence: TTG
aacccaggaggcgaaggttg

SEQ ID NO: 35942 - DNA, 20 bp, Artificial Sequence
  Description of Artificial Sequence: Synthetic oligonucleotide
  Target: FXN; (+) strand; PAM type: YTN; PAM sequence: TTG
taacgaactgaaatcgtgcc

SEQ ID NO: 35943 - DNA, 20 bp, Artificial Sequence
  Description of Artificial Sequence: Synthetic oligonucleotide
  Target: FXN; (+) strand; PAM type: YTN; PAM sequence: CTG
aaatcgtgccacagcactcc

SEQ ID NO: 35944 - DNA, 20 bp, Artificial Sequence
  Description of Artificial Sequence: Synthetic oligonucleotide
  Target: FXN; (+) strand; PAM type: YTN; PAM sequence: CTC
catcctgggcgacagagtga

SEQ ID NO: 35945 - DNA, 20 bp, Artificial Sequence
  Description of Artificial Sequence: Synthetic oligonucleotide
  Target: FXN; (+) strand; PAM type: YTN; PAM sequence: CTG
ggcgacagagtgagactgtc

SEQ ID NO: 35946 - DNA, 20 bp, Artificial Sequence
  Description of Artificial Sequence: Synthetic oligonucleotide
  Target: FXN; (+) strand; PAM type: YTN; PAM sequence: CTG
tctcaaaaaaaggaggagaa

SEQ ID NO: 35947 - DNA, 20 bp, Artificial Sequence
  Description of Artificial Sequence: Synthetic oligonucleotide
  Target: FXN; (+) strand; PAM type: YTN; PAM sequence: CTC
aaaaaaaggaggagaagaag

SEQ ID NO: 35948 - DNA, 20 bp, Artificial Sequence
  Description of Artificial Sequence: Synthetic oligonucleotide
  Target: FXN; (+) strand; PAM type: YTN; PAM sequence: TTG
gagtgaagcaactggcctcc

SEQ ID NO: 35949 - DNA, 20 bp, Artificial Sequence
  Description of Artificial Sequence: Synthetic oligonucleotide
  Target: FXN; (+) strand; PAM type: YTN; PAM sequence: CTG
gcctcctcgtgctaagcggc

SEQ ID NO: 35950 - DNA, 20 bp, Artificial Sequence
  Description of Artificial Sequence: Synthetic oligonucleotide
  Target: FXN; (+) strand; PAM type: YTN; PAM sequence: CTC
ctcgtgctaagcggctactg

SEQ ID NO: 35951 - DNA, 20 bp, Artificial Sequence
  Description of Artificial Sequence: Synthetic oligonucleotide
  Target: FXN; (+) strand; PAM type: YTN; PAM sequence: CTC
gtgctaagcggctactgtga

SEQ ID NO: 35952 - DNA, 20 bp, Artificial Sequence
  Description of Artificial Sequence: Synthetic oligonucleotide
  Target: FXN; (+) strand; PAM type: YTN; PAM sequence: CTA
agcggctactgtgagttctt

SEQ ID NO: 35953 - DNA, 20 bp, Artificial Sequence
  Description of Artificial Sequence: Synthetic oligonucleotide
  Target: FXN; (+) strand; PAM type: YTN; PAM sequence: CTA
ctgtgagttctttccactcc

SEQ ID NO: 35954 - DNA, 20 bp, Artificial Sequence
  Description of Artificial Sequence: Synthetic oligonucleotide
  Target: FXN; (+) strand; PAM type: YTN; PAM sequence: CTG
tgagttctttccactccccc

SEQ ID NO: 35955 - DNA, 20 bp, Artificial Sequence
  Description of Artificial Sequence: Synthetic oligonucleotide
  Target: FXN; (+) strand; PAM type: YTN; PAM sequence: TTC
tttccactcccccaagacat

SEQ ID NO: 35956 - DNA, 20 bp, Artificial Sequence
  Description of Artificial Sequence: Synthetic oligonucleotide
  Target: FXN; (+) strand; PAM type: YTN; PAM sequence: CTT
tccactcccccaagacattg

SEQ ID NO: 35957 - DNA, 20 bp, Artificial Sequence
  Description of Artificial Sequence: Synthetic oligonucleotide
  Target: FXN; (+) strand; PAM type: YTN; PAM sequence: TTT
ccactcccccaagacattgc

SEQ ID NO: 35958 - DNA, 20 bp, Artificial Sequence
  Description of Artificial Sequence: Synthetic oligonucleotide
  Target: FXN; (+) strand; PAM type: YTN; PAM sequence: TTC
cactcccccaagacattgca

SEQ ID NO: 35959 - DNA, 20 bp, Artificial Sequence
  Description of Artificial Sequence: Synthetic oligonucleotide
  Target: FXN; (+) strand; PAM type: YTN; PAM sequence: CTC
ccccaagacattgcataaat

SEQ ID NO: 35960 - DNA, 20 bp, Artificial Sequence
  Description of Artificial Sequence: Synthetic oligonucleotide
  Target: FXN; (+) strand; PAM type: YTN; PAM sequence: TTG
cataaataatgtcactttct

SEQ ID NO: 35961 - DNA, 20 bp, Artificial Sequence
  Description of Artificial Sequence: Synthetic oligonucleotide
  Target: FXN; (+) strand; PAM type: YTN; PAM sequence: CTT
tctgacactcaccccgctga

SEQ ID NO: 35962 - DNA, 20 bp, Artificial Sequence
  Description of Artificial Sequence: Synthetic oligonucleotide
  Target: FXN; (+) strand; PAM type: YTN; PAM sequence: TTT
ctgacactcaccccgctgaa

SEQ ID NO: 35963 - DNA, 20 bp, Artificial Sequence
  Description of Artificial Sequence: Synthetic oligonucleotide
  Target: FXN; (+) strand; PAM type: YTN; PAM sequence: TTC
tgacactcaccccgctgaat

SEQ ID NO: 35964 - DNA, 20 bp, Artificial Sequence
  Description of Artificial Sequence: Synthetic oligonucleotide
  Target: FXN; (+) strand; PAM type: YTN; PAM sequence: CTG
acactcaccccgctgaatgt

SEQ ID NO: 35965 - DNA, 20 bp, Artificial Sequence
  Description of Artificial Sequence: Synthetic oligonucleotide
  Target: FXN; (+) strand; PAM type: YTN; PAM sequence: CTC
accccgctgaatgtcctgcc

SEQ ID NO: 35966 - DNA, 20 bp, Artificial Sequence
  Description of Artificial Sequence: Synthetic oligonucleotide
  Target: FXN; (+) strand; PAM type: YTN; PAM sequence: CTG
aatgtcctgcctctgctcaa

SEQ ID NO: 35967 - DNA, 20 bp, Artificial Sequence
  Description of Artificial Sequence: Synthetic oligonucleotide
  Target: FXN; (+) strand; PAM type: YTN; PAM sequence: CTG
cctctgctcaagggtggtat

SEQ ID NO: 35968 - DNA, 20 bp, Artificial Sequence
  Description of Artificial Sequence: Synthetic oligonucleotide
  Target: FXN; (+) strand; PAM type: YTN; PAM sequence: CTC
tgctcaagggtggtatgatg

SEQ ID NO: 35969 - DNA, 20 bp, Artificial Sequence
  Description of Artificial Sequence: Synthetic oligonucleotide
  Target: FXN; (+) strand; PAM type: YTN; PAM sequence: CTG
ctcaagggtggtatgatggg

SEQ ID NO: 35970 - DNA, 20 bp, Artificial Sequence
  Description of Artificial Sequence: Synthetic oligonucleotide
  Target: FXN; (+) strand; PAM type: YTN; PAM sequence: CTC
aagggtggtatgatggggac

SEQ ID NO: 35971 - DNA, 20 bp, Artificial Sequence
  Description of Artificial Sequence: Synthetic oligonucleotide
  Target: FXN; (+) strand; PAM type: YTN; PAM sequence: CTT
ggcagtggaggggaacaggg

SEQ ID NO: 35972 - DNA, 20 bp, Artificial Sequence
  Description of Artificial Sequence: Synthetic oligonucleotide
  Target: FXN; (+) strand; PAM type: YTN; PAM sequence: TTG
gcagtggaggggaacaggga

SEQ ID NO: 35973 - DNA, 20 bp, Artificial Sequence
  Description of Artificial Sequence: Synthetic oligonucleotide
  Target: FXN; (+) strand; PAM type: YTN; PAM sequence: CTC
cccgcttcctggctacaagt

SEQ ID NO: 35974 - DNA, 20 bp, Artificial Sequence
  Description of Artificial Sequence: Synthetic oligonucleotide
  Target: FXN; (+) strand; PAM type: YTN; PAM sequence: CTT
cctggctacaagtccctctg

SEQ ID NO: 35975 - DNA, 20 bp, Artificial Sequence
  Description of Artificial Sequence: Synthetic oligonucleotide
  Target: FXN; (+) strand; PAM type: YTN; PAM sequence: TTC
ctggctacaagtccctctga

SEQ ID NO: 35976 - DNA, 20 bp, Artificial Sequence
  Description of Artificial Sequence: Synthetic oligonucleotide
  Target: FXN; (+) strand; PAM type: YTN; PAM sequence: CTG
gctacaagtccctctgaaga

SEQ ID NO: 35977 - DNA, 20 bp, Artificial Sequence
  Description of Artificial Sequence: Synthetic oligonucleotide
  Target: FXN; (+) strand; PAM type: YTN; PAM sequence: CTA
caagtccctctgaagaaatc

SEQ ID NO: 35978 - DNA, 20 bp, Artificial Sequence
  Description of Artificial Sequence: Synthetic oligonucleotide
  Target: FXN; (+) strand; PAM type: YTN; PAM sequence: CTC
tgaagaaatccaaaggagta

SEQ ID NO: 35979 - DNA, 20 bp, Artificial Sequence
  Description of Artificial Sequence: Synthetic oligonucleotide
  Target: FXN; (+) strand; PAM type: YTN; PAM sequence: CTG
aagaaatccaaaggagtaaa

SEQ ID NO: 35980 - DNA, 20 bp, Artificial Sequence
  Description of Artificial Sequence: Synthetic oligonucleotide
  Target: FXN; (+) strand; PAM type: YTN; PAM sequence: CTT
ggagagtaggcctctgtagg

SEQ ID NO: 35981 - DNA, 20 bp, Artificial Sequence
  Description of Artificial Sequence: Synthetic oligonucleotide
  Target: FXN; (+) strand; PAM type: YTN; PAM sequence: TTG
gagagtaggcctctgtaggg

SEQ ID NO: 35982 - DNA, 20 bp, Artificial Sequence
  Description of Artificial Sequence: Synthetic oligonucleotide
  Target: FXN; (+) strand; PAM type: YTN; PAM sequence: CTC
tgtagggtgcaagggcacag

SEQ ID NO: 35983 - DNA, 20 bp, Artificial Sequence
  Description of Artificial Sequence: Synthetic oligonucleotide
  Target: FXN; (+) strand; PAM type: YTN; PAM sequence: CTG
tagggtgcaagggcacagct

SEQ ID NO: 35984 - DNA, 20 bp, Artificial Sequence
  Description of Artificial Sequence: Synthetic oligonucleotide
  Target: FXN; (+) strand; PAM type: YTN; PAM sequence: CTG
gagacggagctcctgaggct

SEQ ID NO: 35985 - DNA, 20 bp, Artificial Sequence
  Description of Artificial Sequence: Synthetic oligonucleotide
  Target: FXN; (+) strand; PAM type: YTN; PAM sequence: CTC
ctgaggctgcagctgatgct

SEQ ID NO: 35986 - DNA, 20 bp, Artificial Sequence
  Description of Artificial Sequence: Synthetic oligonucleotide
  Target: FXN; (+) strand; PAM type: YTN; PAM sequence: CTG
aggctgcagctgatgctgcc

SEQ ID NO: 35987 - DNA, 20 bp, Artificial Sequence
  Description of Artificial Sequence: Synthetic oligonucleotide
  Target: FXN; (+) strand; PAM type: YTN; PAM sequence: CTG
cagctgatgctgcccgctct

SEQ ID NO: 35988 - DNA, 20 bp, Artificial Sequence
  Description of Artificial Sequence: Synthetic oligonucleotide
  Target: FXN; (+) strand; PAM type: YTN; PAM sequence: CTG
atgctgcccgctctgcctga

SEQ ID NO: 35989 - DNA, 20 bp, Artificial Sequence
  Description of Artificial Sequence: Synthetic oligonucleotide
  Target: FXN; (+) strand; PAM type: YTN; PAM sequence: CTG
cccgctctgcctgaactgca

SEQ ID NO: 35990 - DNA, 20 bp, Artificial Sequence
  Description of Artificial Sequence: Synthetic oligonucleotide
  Target: FXN; (+) strand; PAM type: YTN; PAM sequence: CTC
tgcctgaactgcaccaaaaa

SEQ ID NO: 35991 - DNA, 20 bp, Artificial Sequence
  Description of Artificial Sequence: Synthetic oligonucleotide
  Target: FXN; (+) strand; PAM type: YTN; PAM sequence: CTG
cctgaactgcaccaaaaacg

SEQ ID NO: 35992 - DNA, 20 bp, Artificial Sequence
  Description of Artificial Sequence: Synthetic oligonucleotide
  Target: FXN; (+) strand; PAM type: YTN; PAM sequence: CTG
aactgcaccaaaaacgtgat

SEQ ID NO: 35993 - DNA, 20 bp, Artificial Sequence
  Description of Artificial Sequence: Synthetic oligonucleotide
  Target: FXN; (+) strand; PAM type: YTN; PAM sequence: CTG
caccaaaaacgtgatgaggc

SEQ ID NO: 35994 - DNA, 20 bp, Artificial Sequence
  Description of Artificial Sequence: Synthetic oligonucleotide
  Target: FXN; (+) strand; PAM type: YTN; PAM sequence: CTA
ctgcccgacctctagcagag

SEQ ID NO: 35995 - DNA, 20 bp, Artificial Sequence
  Description of Artificial Sequence: Synthetic oligonucleotide
  Target: FXN; (+) strand; PAM type: YTN; PAM sequence: CTG
cccgacctctagcagagact

SEQ ID NO: 35996 - DNA, 20 bp, Artificial Sequence
  Description of Artificial Sequence: Synthetic oligonucleotide
  Target: FXN; (+) strand; PAM type: YTN; PAM sequence: CTC
tagcagagactaagcaaggt

SEQ ID NO: 35997 - DNA, 20 bp, Artificial Sequence
  Description of Artificial Sequence: Synthetic oligonucleotide
  Target: FXN; (+) strand; PAM type: YTN; PAM sequence: CTA
gcagagactaagcaaggtgc

SEQ ID NO: 35998 - DNA, 20 bp, Artificial Sequence
  Description of Artificial Sequence: Synthetic oligonucleotide
  Target: FXN; (+) strand; PAM type: YTN; PAM sequence: CTA
agcaaggtgcatgaaaactt

SEQ ID NO: 35999 - DNA, 20 bp, Artificial Sequence
  Description of Artificial Sequence: Synthetic oligonucleotide
  Target: FXN; (+) strand; PAM type: YTN; PAM sequence: CTT
gaaccacatgtgtcacaccc

SEQ ID NO: 36000 - DNA, 20 bp, Artificial Sequence
  Description of Artificial Sequence: Synthetic oligonucleotide
  Target: FXN; (+) strand; PAM type: YTN; PAM sequence: TTG
aaccacatgtgtcacaccca

SEQ ID NO: 36001 - DNA, 20 bp, Artificial Sequence
  Description of Artificial Sequence: Synthetic oligonucleotide
  Target: FXN; (+) strand; PAM type: YTN; PAM sequence: CTA
catgaagatggcccaaaacc

SEQ ID NO: 36002 - DNA, 20 bp, Artificial Sequence
  Description of Artificial Sequence: Synthetic oligonucleotide
  Target: FXN; (+) strand; PAM type: YTN; PAM sequence: CTG
gcccaggaattgaagaaaga

SEQ ID NO: 36003 - DNA, 20 bp, Artificial Sequence
  Description of Artificial Sequence: Synthetic oligonucleotide
  Target: FXN; (+) strand; PAM type: YTN; PAM sequence: TTG
aagaaagactcttccaattt

SEQ ID NO: 36004 - DNA, 20 bp, Artificial Sequence
  Description of Artificial Sequence: Synthetic oligonucleotide
  Target: FXN; (+) strand; PAM type: YTN; PAM sequence: CTC
ttccaatttgctgtaagaaa

SEQ ID NO: 36005 - DNA, 20 bp, Artificial Sequence
  Description of Artificial Sequence: Synthetic oligonucleotide
  Target: FXN; (+) strand; PAM type: YTN; PAM sequence: CTT
ccaatttgctgtaagaaaat

SEQ ID NO: 36006 - DNA, 20 bp, Artificial Sequence
  Description of Artificial Sequence: Synthetic oligonucleotide
  Target: FXN; (+) strand; PAM type: YTN; PAM sequence: TTC
caatttgctgtaagaaaatg

SEQ ID NO: 36007 - DNA, 20 bp, Artificial Sequence
  Description of Artificial Sequence: Synthetic oligonucleotide
  Target: FXN; (+) strand; PAM type: YTN; PAM sequence: TTT
gctgtaagaaaatggcccag

SEQ ID NO: 36008 - DNA, 20 bp, Artificial Sequence
  Description of Artificial Sequence: Synthetic oligonucleotide
  Target: FXN; (+) strand; PAM type: YTN; PAM sequence: TTG
ctgtaagaaaatggcccagg

SEQ ID NO: 36009 - DNA, 20 bp, Artificial Sequence
  Description of Artificial Sequence: Synthetic oligonucleotide
  Target: FXN; (+) strand; PAM type: YTN; PAM sequence: CTG
taagaaaatggcccaggggg

SEQ ID NO: 36010 - DNA, 20 bp, Artificial Sequence
  Description of Artificial Sequence: Synthetic oligonucleotide
  Target: FXN; (+) strand; PAM type: YTN; PAM sequence: CTC
acacctgtaatcctagcact

SEQ ID NO: 36011 - DNA, 20 bp, Artificial Sequence
  Description of Artificial Sequence: Synthetic oligonucleotide
  Target: FXN; (+) strand; PAM type: YTN; PAM sequence: CTG
taatcctagcactttgggaa

SEQ ID NO: 36012 - DNA, 20 bp, Artificial Sequence
  Description of Artificial Sequence: Synthetic oligonucleotide
  Target: FXN; (+) strand; PAM type: YTN; PAM sequence: CTA
gcactttgggaagctgacgc

SEQ ID NO: 36013 - DNA, 20 bp, Artificial Sequence
  Description of Artificial Sequence: Synthetic oligonucleotide
  Target: FXN; (+) strand; PAM type: YTN; PAM sequence: CTT
tgggaagctgacgcaggcag

SEQ ID NO: 36014 - DNA, 20 bp, Artificial Sequence
  Description of Artificial Sequence: Synthetic oligonucleotide
  Target: FXN; (+) strand; PAM type: YTN; PAM sequence: TTT
gggaagctgacgcaggcaga

SEQ ID NO: 36015 - DNA, 20 bp, Artificial Sequence
  Description of Artificial Sequence: Synthetic oligonucleotide
  Target: FXN; (+) strand; PAM type: YTN; PAM sequence: TTG
ggaagctgacgcaggcagat

SEQ ID NO: 36016 - DNA, 20 bp, Artificial Sequence
  Description of Artificial Sequence: Synthetic oligonucleotide
  Target: FXN; (+) strand; PAM type: YTN; PAM sequence: CTG
acgcaggcagatggcttgag

SEQ ID NO: 36017 - DNA, 20 bp, Artificial Sequence
  Description of Artificial Sequence: Synthetic oligonucleotide
  Target: FXN; (+) strand; PAM type: YTN; PAM sequence: CTT
gagctcaggagttccagacc

SEQ ID NO: 36018 - DNA, 20 bp, Artificial Sequence
  Description of Artificial Sequence: Synthetic oligonucleotide
  Target: FXN; (+) strand; PAM type: YTN; PAM sequence: TTG
agctcaggagttccagacca

SEQ ID NO: 36019 - DNA, 20 bp, Artificial Sequence
  Description of Artificial Sequence: Synthetic oligonucleotide
  Target: FXN; (+) strand; PAM type: YTN; PAM sequence: CTC
aggagttccagaccagcctg

SEQ ID NO: 36020 - DNA, 20 bp, Artificial Sequence
  Description of Artificial Sequence: Synthetic oligonucleotide
  Target: FXN; (+) strand; PAM type: YTN; PAM sequence: TTC
cagaccagcctgggcaacat

SEQ ID NO: 36021 - DNA, 20 bp, Artificial Sequence
  Description of Artificial Sequence: Synthetic oligonucleotide
  Target: FXN; (+) strand; PAM type: YTN; PAM sequence: CTG
ggcaacatggtgaaaccccg

SEQ ID NO: 36022 - DNA, 20 bp, Artificial Sequence
  Description of Artificial Sequence: Synthetic oligonucleotide
  Target: FXN; (+) strand; PAM type: YTN; PAM sequence: CTC
taccaaaaatacaaaaatta

SEQ ID NO: 36023 - DNA, 20 bp, Artificial Sequence
  Description of Artificial Sequence: Synthetic oligonucleotide
  Target: FXN; (+) strand; PAM type: YTN; PAM sequence: CTA
ccaaaaatacaaaaattagc

SEQ ID NO: 36024 - DNA, 20 bp, Artificial Sequence
  Description of Artificial Sequence: Synthetic oligonucleotide
  Target: FXN; (+) strand; PAM type: YTN; PAM sequence: TTA
gccgggtgtggtgatgcatg

SEQ ID NO: 36025 - DNA, 20 bp, Artificial Sequence
  Description of Artificial Sequence: Synthetic oligonucleotide
  Target: FXN; (+) strand; PAM type: YTN; PAM sequence: CTG
tggtcccagctactcaggag

SEQ ID NO: 36026 - DNA, 20 bp, Artificial Sequence
  Description of Artificial Sequence: Synthetic oligonucleotide
  Target: FXN; (+) strand; PAM type: YTN; PAM sequence: CTA
ctcaggaggctgaggtggaa

SEQ ID NO: 36027 - DNA, 20 bp, Artificial Sequence
  Description of Artificial Sequence: Synthetic oligonucleotide
  Target: FXN; (+) strand; PAM type: YTN; PAM sequence: CTC
aggaggctgaggtggaagga

SEQ ID NO: 36028 - DNA, 20 bp, Artificial Sequence
  Description of Artificial Sequence: Synthetic oligonucleotide
  Target: FXN; (+) strand; PAM type: YTN; PAM sequence: CTG
aggtggaaggattgcctgag

SEQ ID NO: 36029 - DNA, 20 bp, Artificial Sequence
  Description of Artificial Sequence: Synthetic oligonucleotide
  Target: FXN; (+) strand; PAM type: YTN; PAM sequence: TTG
cctgagtctgtggggcagag

SEQ ID NO: 36030 - DNA, 20 bp, Artificial Sequence
  Description of Artificial Sequence: Synthetic oligonucleotide
  Target: FXN; (+) strand; PAM type: YTN; PAM sequence: CTG
agtctgtggggcagaggttg

SEQ ID NO: 36031 - DNA, 20 bp, Artificial Sequence
  Description of Artificial Sequence: Synthetic oligonucleotide
  Target: FXN; (+) strand; PAM type: YTN; PAM sequence: CTG
tggggcagaggttgcagtga

SEQ ID NO: 36032 - DNA, 20 bp, Artificial Sequence
  Description of Artificial Sequence: Synthetic oligonucleotide
  Target: FXN; (+) strand; PAM type: YTN; PAM sequence: TTG
cagtgagctgagatcacacc

SEQ ID NO: 36033 - DNA, 20 bp, Artificial Sequence
  Description of Artificial Sequence: Synthetic oligonucleotide
  Target: FXN; (+) strand; PAM type: YTN; PAM sequence: CTG
agatcacaccactgcactcc

SEQ ID NO: 36034 - DNA, 20 bp, Artificial Sequence
  Description of Artificial Sequence: Synthetic oligonucleotide
  Target: FXN; (+) strand; PAM type: YTN; PAM sequence: CTG
cactccagcctgggtgacac

SEQ ID NO: 36035 - DNA, 20 bp, Artificial Sequence
  Description of Artificial Sequence: Synthetic oligonucleotide
  Target: FXN; (+) strand; PAM type: YTN; PAM sequence: CTC
cagcctgggtgacacagtga

SEQ ID NO: 36036 - DNA, 20 bp, Artificial Sequence
  Description of Artificial Sequence: Synthetic oligonucleotide
  Target: FXN; (+) strand; PAM type: YTN; PAM sequence: CTG
ggtgacacagtgagacccca

SEQ ID NO: 36037 - DNA, 20 bp, Artificial Sequence
  Description of Artificial Sequence: Synthetic oligonucleotide
  Target: FXN; (+) strand; PAM type: YTN; PAM sequence: CTC
aaaaaaaaaaaaaagaaaga

SEQ ID NO: 36038 - DNA, 20 bp, Artificial Sequence
  Description of Artificial Sequence: Synthetic oligonucleotide
  Target: FXN; (+) strand; PAM type: YTN; PAM sequence: CTG
gagggccgccgtgtccattg

SEQ ID NO: 36039 - DNA, 20 bp, Artificial Sequence
  Description of Artificial Sequence: Synthetic oligonucleotide
  Target: FXN; (+) strand; PAM type: YTN; PAM sequence: TTG
agagagtgctccaggcactc

SEQ ID NO: 36040 - DNA, 20 bp, Artificial Sequence
  Description of Artificial Sequence: Synthetic oligonucleotide
  Target: FXN; (+) strand; PAM type: YTN; PAM sequence: CTC
caggcactccaaaaagaaaa

SEQ ID NO: 36041 - DNA, 20 bp, Artificial Sequence
  Description of Artificial Sequence: Synthetic oligonucleotide
  Target: FXN; (+) strand; PAM type: YTN; PAM sequence: CTC
caaaaagaaaatgaccacaa

SEQ ID NO: 36042 - DNA, 20 bp, Artificial Sequence
  Description of Artificial Sequence: Synthetic oligonucleotide
  Target: FXN; (+) strand; PAM type: YTN; PAM sequence: CTG
accatgagaccaagttccaa

SEQ ID NO: 36043 - DNA, 20 bp, Artificial Sequence
  Description of Artificial Sequence: Synthetic oligonucleotide
  Target: FXN; (+) strand; PAM type: YTN; PAM sequence: TTC
caaccttttacaagtggcct

SEQ ID NO: 36044 - DNA, 20 bp, Artificial Sequence
  Description of Artificial Sequence: Synthetic oligonucleotide
  Target: FXN; (+) strand; PAM type: YTN; PAM sequence: CTT
ttacaagtggcctgtggctc

SEQ ID NO: 36045 - DNA, 20 bp, Artificial Sequence
  Description of Artificial Sequence: Synthetic oligonucleotide
  Target: FXN; (+) strand; PAM type: YTN; PAM sequence: TTT
tacaagtggcctgtggctcc

SEQ ID NO: 36046 - DNA, 20 bp, Artificial Sequence
  Description of Artificial Sequence: Synthetic oligonucleotide
  Target: FXN; (+) strand; PAM type: YTN; PAM sequence: TTT
acaagtggcctgtggctcct

SEQ ID NO: 36047 - DNA, 20 bp, Artificial Sequence
  Description of Artificial Sequence: Synthetic oligonucleotide
  Target: FXN; (+) strand; PAM type: YTN; PAM sequence: TTA
caagtggcctgtggctcctg

SEQ ID NO: 36048 - DNA, 20 bp, Artificial Sequence
  Description of Artificial Sequence: Synthetic oligonucleotide
  Target: FXN; (+) strand; PAM type: YTN; PAM sequence: CTG
tggctcctggcgccccgccc

SEQ ID NO: 36049 - DNA, 20 bp, Artificial Sequence
  Description of Artificial Sequence: Synthetic oligonucleotide
  Target: FXN; (+) strand; PAM type: YTN; PAM sequence: CTC
ctggcgccccgcccacagct

SEQ ID NO: 36050 - DNA, 20 bp, Artificial Sequence
  Description of Artificial Sequence: Synthetic oligonucleotide
  Target: FXN; (+) strand; PAM type: YTN; PAM sequence: CTG
gcgccccgcccacagctgac

SEQ ID NO: 36051 - DNA, 20 bp, Artificial Sequence
  Description of Artificial Sequence: Synthetic oligonucleotide
  Target: FXN; (+) strand; PAM type: YTN; PAM sequence: CTG
acaggggctcagaagtgcta

SEQ ID NO: 36052 - DNA, 20 bp, Artificial Sequence
  Description of Artificial Sequence: Synthetic oligonucleotide
  Target: FXN; (+) strand; PAM type: YTN; PAM sequence: CTC
agaagtgctagggggaccat

SEQ ID NO: 36053 - DNA, 20 bp, Artificial Sequence
  Description of Artificial Sequence: Synthetic oligonucleotide
  Target: FXN; (+) strand; PAM type: YTN; PAM sequence: CTA
gggggaccatgggccaccag

SEQ ID NO: 36054 - DNA, 20 bp, Artificial Sequence
  Description of Artificial Sequence: Synthetic oligonucleotide
  Target: FXN; (+) strand; PAM type: YTN; PAM sequence: CTT
ggatgcagaacaccagctgg

SEQ ID NO: 36055 - DNA, 20 bp, Artificial Sequence
  Description of Artificial Sequence: Synthetic oligonucleotide
  Target: FXN; (+) strand; PAM type: YTN; PAM sequence: TTG
gatgcagaacaccagctggt

SEQ ID NO: 36056 - DNA, 20 bp, Artificial Sequence
  Description of Artificial Sequence: Synthetic oligonucleotide
  Target: FXN; (+) strand; PAM type: YTN; PAM sequence: CTG
gtttgattctgttttccctg

SEQ ID NO: 36057 - DNA, 20 bp, Artificial Sequence
  Description of Artificial Sequence: Synthetic oligonucleotide
  Target: FXN; (+) strand; PAM type: YTN; PAM sequence: TTT
gattctgttttccctgtacc

SEQ ID NO: 36058 - DNA, 20 bp, Artificial Sequence
  Description of Artificial Sequence: Synthetic oligonucleotide
  Target: FXN; (+) strand; PAM type: YTN; PAM sequence: TTG
attctgttttccctgtacct

SEQ ID NO: 36059 - DNA, 20 bp, Artificial Sequence
  Description of Artificial Sequence: Synthetic oligonucleotide
  Target: FXN; (+) strand; PAM type: YTN; PAM sequence: TTC
tgttttccctgtacctgggt

SEQ ID NO: 36060 - DNA, 20 bp, Artificial Sequence
  Description of Artificial Sequence: Synthetic oligonucleotide
  Target: FXN; (+) strand; PAM type: YTN; PAM sequence: CTG
ttttccctgtacctgggtcc

SEQ ID NO: 36061 - DNA, 20 bp, Artificial Sequence
  Description of Artificial Sequence: Synthetic oligonucleotide
  Target: FXN; (+) strand; PAM type: YTN; PAM sequence: TTT
tccctgtacctgggtcctga

SEQ ID NO: 36062 - DNA, 20 bp, Artificial Sequence
  Description of Artificial Sequence: Synthetic oligonucleotide
  Target: FXN; (+) strand; PAM type: YTN; PAM sequence: TTT
ccctgtacctgggtcctgaa

SEQ ID NO: 36063 - DNA, 20 bp, Artificial Sequence
  Description of Artificial Sequence: Synthetic oligonucleotide
  Target: FXN; (+) strand; PAM type: YTN; PAM sequence: TTC
cctgtacctgggtcctgaat

SEQ ID NO: 36064 - DNA, 20 bp, Artificial Sequence
  Description of Artificial Sequence: Synthetic oligonucleotide
  Target: FXN; (+) strand; PAM type: YTN; PAM sequence: CTG
tacctgggtcctgaatgccc

SEQ ID NO: 36065 - DNA, 20 bp, Artificial Sequence
  Description of Artificial Sequence: Synthetic oligonucleotide
  Target: FXN; (+) strand; PAM type: YTN; PAM sequence: CTG
ggtcctgaatgcccagaggc

SEQ ID NO: 36066 - DNA, 20 bp, Artificial Sequence
  Description of Artificial Sequence: Synthetic oligonucleotide
  Target: FXN; (+) strand; PAM type: YTN; PAM sequence: CTG
aatgcccagaggctcaggga

SEQ ID NO: 36067 - DNA, 20 bp, Artificial Sequence
  Description of Artificial Sequence: Synthetic oligonucleotide
  Target: FXN; (+) strand; PAM type: YTN; PAM sequence: CTC
agggaaacaccagccagtgc

SEQ ID NO: 36068 - DNA, 20 bp, Artificial Sequence
  Description of Artificial Sequence: Synthetic oligonucleotide
  Target: FXN; (+) strand; PAM type: YTN; PAM sequence: CTG
ctgcctttaaagcacttttg

SEQ ID NO: 36069 - DNA, 20 bp, Artificial Sequence
  Description of Artificial Sequence: Synthetic oligonucleotide
  Target: FXN; (+) strand; PAM type: YTN; PAM sequence: CTG
cctttaaagcacttttgact

SEQ ID NO: 36070 - DNA, 20 bp, Artificial Sequence
  Description of Artificial Sequence: Synthetic oligonucleotide
  Target: FXN; (+) strand; PAM type: YTN; PAM sequence: CTT
taaagcacttttgactgatc

SEQ ID NO: 36071 - DNA, 20 bp, Artificial Sequence
  Description of Artificial Sequence: Synthetic oligonucleotide
  Target: FXN; (+) strand; PAM type: YTN; PAM sequence: TTT
aaagcacttttgactgatct

SEQ ID NO: 36072 - DNA, 20 bp, Artificial Sequence
  Description of Artificial Sequence: Synthetic oligonucleotide
  Target: FXN; (+) strand; PAM type: YTN; PAM sequence: TTA
aagcacttttgactgatctc

SEQ ID NO: 36073 - DNA, 20 bp, Artificial Sequence
  Description of Artificial Sequence: Synthetic oligonucleotide
  Target: FXN; (+) strand; PAM type: YTN; PAM sequence: CTT
ttgactgatctcttgttaat

SEQ ID NO: 36074 - DNA, 20 bp, Artificial Sequence
  Description of Artificial Sequence: Synthetic oligonucleotide
  Target: FXN; (+) strand; PAM type: YTN; PAM sequence: TTT
tgactgatctcttgttaatt

SEQ ID NO: 36075 - DNA, 20 bp, Artificial Sequence
  Description of Artificial Sequence: Synthetic oligonucleotide
  Target: FXN; (+) strand; PAM type: YTN; PAM sequence: TTT
gactgatctcttgttaattt

SEQ ID NO: 36076 - DNA, 20 bp, Artificial Sequence
  Description of Artificial Sequence: Synthetic oligonucleotide
  Target: FXN; (+) strand; PAM type: YTN; PAM sequence: TTG
actgatctcttgttaattta

SEQ ID NO: 36077 - DNA, 20 bp, Artificial Sequence
  Description of Artificial Sequence: Synthetic oligonucleotide
  Target: FXN; (+) strand; PAM type: YTN; PAM sequence: CTG
atctcttgttaatttagcaa

SEQ ID NO: 36078 - DNA, 20 bp, Artificial Sequence
  Description of Artificial Sequence: Synthetic oligonucleotide
  Target: FXN; (+) strand; PAM type: YTN; PAM sequence: CTC
ttgttaatttagcaactgtt

SEQ ID NO: 36079 - DNA, 20 bp, Artificial Sequence
  Description of Artificial Sequence: Synthetic oligonucleotide
  Target: FXN; (+) strand; PAM type: YTN; PAM sequence: CTT
gttaatttagcaactgttat

SEQ ID NO: 36080 - DNA, 20 bp, Artificial Sequence
  Description of Artificial Sequence: Synthetic oligonucleotide
  Target: FXN; (+) strand; PAM type: YTN; PAM sequence: TTG
ttaatttagcaactgttatt

SEQ ID NO: 36081 - DNA, 20 bp, Artificial Sequence
  Description of Artificial Sequence: Synthetic oligonucleotide
  Target: FXN; (+) strand; PAM type: YTN; PAM sequence: TTA
atttagcaactgttattggt

SEQ ID NO: 36082 - DNA, 20 bp, Artificial Sequence
  Description of Artificial Sequence: Synthetic oligonucleotide
  Target: FXN; (+) strand; PAM type: YTN; PAM sequence: TTT
agcaactgttattggttgat

SEQ ID NO: 36083 - DNA, 20 bp, Artificial Sequence
  Description of Artificial Sequence: Synthetic oligonucleotide
  Target: FXN; (+) strand; PAM type: YTN; PAM sequence: TTA
gcaactgttattggttgatg

SEQ ID NO: 36084 - DNA, 20 bp, Artificial Sequence
  Description of Artificial Sequence: Synthetic oligonucleotide
  Target: FXN; (+) strand; PAM type: YTN; PAM sequence: CTG
ttattggttgatgctgcagt

SEQ ID NO: 36085 - DNA, 20 bp, Artificial Sequence
  Description of Artificial Sequence: Synthetic oligonucleotide
  Target: FXN; (+) strand; PAM type: YTN; PAM sequence: TTA
ttggttgatgctgcagttgc

SEQ ID NO: 36086 - DNA, 20 bp, Artificial Sequence
  Description of Artificial Sequence: Synthetic oligonucleotide
  Target: FXN; (+) strand; PAM type: YTN; PAM sequence: TTG
gttgatgctgcagttgctct

SEQ ID NO: 36087 - DNA, 20 bp, Artificial Sequence
  Description of Artificial Sequence: Synthetic oligonucleotide
  Target: FXN; (+) strand; PAM type: YTN; PAM sequence: TTG
atgctgcagttgctcttatt

SEQ ID NO: 36088 - DNA, 20 bp, Artificial Sequence
  Description of Artificial Sequence: Synthetic oligonucleotide
  Target: FXN; (+) strand; PAM type: YTN; PAM sequence: CTG
cagttgctcttattgaagtt

SEQ ID NO: 36089 - DNA, 20 bp, Artificial Sequence
  Description of Artificial Sequence: Synthetic oligonucleotide
  Target: FXN; (+) strand; PAM type: YTN; PAM sequence: TTG
ctcttattgaagtttgattg

SEQ ID NO: 36090 - DNA, 20 bp, Artificial Sequence
  Description of Artificial Sequence: Synthetic oligonucleotide
  Target: FXN; (+) strand; PAM type: YTN; PAM sequence: CTC
ttattgaagtttgattgata

SEQ ID NO: 36091 - DNA, 20 bp, Artificial Sequence
  Description of Artificial Sequence: Synthetic oligonucleotide
  Target: FXN; (+) strand; PAM type: YTN; PAM sequence: CTT
attgaagtttgattgatagc

SEQ ID NO: 36092 - DNA, 20 bp, Artificial Sequence
  Description of Artificial Sequence: Synthetic oligonucleotide
  Target: FXN; (+) strand; PAM type: YTN; PAM sequence: TTA
ttgaagtttgattgatagca

SEQ ID NO: 36093 - DNA, 20 bp, Artificial Sequence
  Description of Artificial Sequence: Synthetic oligonucleotide
  Target: FXN; (+) strand; PAM type: YTN; PAM sequence: TTG
aagtttgattgatagcatta

SEQ ID NO: 36094 - DNA, 20 bp, Artificial Sequence
  Description of Artificial Sequence: Synthetic oligonucleotide
  Target: FXN; (+) strand; PAM type: YTN; PAM sequence: TTT
gattgatagcattaggatgg

SEQ ID NO: 36095 - DNA, 20 bp, Artificial Sequence
  Description of Artificial Sequence: Synthetic oligonucleotide
  Target: FXN; (+) strand; PAM type: YTN; PAM sequence: TTG
attgatagcattaggatggt

SEQ ID NO: 36096 - DNA, 20 bp, Artificial Sequence
  Description of Artificial Sequence: Synthetic oligonucleotide
  Target: FXN; (+) strand; PAM type: YTN; PAM sequence: TTG
atagcattaggatggtaagg

SEQ ID NO: 36097 - DNA, 20 bp, Artificial Sequence
  Description of Artificial Sequence: Synthetic oligonucleotide
  Target: FXN; (+) strand; PAM type: YTN; PAM sequence: TTA
ggatggtaaggcactatttt

SEQ ID NO: 36098 - DNA, 20 bp, Artificial Sequence
  Description of Artificial Sequence: Synthetic oligonucleotide
  Target: FXN; (+) strand; PAM type: YTN; PAM sequence: CTA
tttttcaaataaaggttgtt

SEQ ID NO: 36099 - DNA, 20 bp, Artificial Sequence
  Description of Artificial Sequence: Synthetic oligonucleotide
  Target: FXN; (+) strand; PAM type: YTN; PAM sequence: TTT
ttcaaataaaggttgtttaa

SEQ ID NO: 36100 - DNA, 20 bp, Artificial Sequence
  Description of Artificial Sequence: Synthetic oligonucleotide
  Target: FXN; (+) strand; PAM type: YTN; PAM sequence: TTT
tcaaataaaggttgtttaat

SEQ ID NO: 36101 - DNA, 20 bp, Artificial Sequence
  Description of Artificial Sequence: Synthetic oligonucleotide
  Target: FXN; (+) strand; PAM type: YTN; PAM sequence: TTT
caaataaaggttgtttaata

SEQ ID NO: 36102 - DNA, 20 bp, Artificial Sequence
  Description of Artificial Sequence: Synthetic oligonucleotide
  Target: FXN; (+) strand; PAM type: YTN; PAM sequence: TTC
aaataaaggttgtttaatat

SEQ ID NO: 36103 - DNA, 20 bp, Artificial Sequence
  Description of Artificial Sequence: Synthetic oligonucleotide
  Target: FXN; (+) strand; PAM type: YTN; PAM sequence: TTG
tttaatataaaaaaaatttt

SEQ ID NO: 36104 - DNA, 20 bp, Artificial Sequence
  Description of Artificial Sequence: Synthetic oligonucleotide
  Target: FXN; (+) strand; PAM type: YTN; PAM sequence: TTT
aatataaaaaaaattttgtt

SEQ ID NO: 36105 - DNA, 20 bp, Artificial Sequence
  Description of Artificial Sequence: Synthetic oligonucleotide
  Target: FXN; (+) strand; PAM type: YTN; PAM sequence: TTA
atataaaaaaaattttgttt

SEQ ID NO: 36106 - DNA, 20 bp, Artificial Sequence
  Description of Artificial Sequence: Synthetic oligonucleotide
  Target: FXN; (+) strand; PAM type: YTN; PAM sequence: TTT
tgtttttttttctctcagcc

SEQ ID NO: 36107 - DNA, 20 bp, Artificial Sequence
  Description of Artificial Sequence: Synthetic oligonucleotide
  Target: FXN; (+) strand; PAM type: YTN; PAM sequence: TTT
gtttttttttctctcagcct

SEQ ID NO: 36108 - DNA, 20 bp, Artificial Sequence
  Description of Artificial Sequence: Synthetic oligonucleotide
  Target: FXN; (+) strand; PAM type: YTN; PAM sequence: TTG
tttttttttctctcagcctt

SEQ ID NO: 36109 - DNA, 20 bp, Artificial Sequence
  Description of Artificial Sequence: Synthetic oligonucleotide
  Target: FXN; (+) strand; PAM type: YTN; PAM sequence: TTT
ttttttctctcagcctttca

SEQ ID NO: 36110 - DNA, 20 bp, Artificial Sequence
  Description of Artificial Sequence: Synthetic oligonucleotide
  Target: FXN; (+) strand; PAM type: YTN; PAM sequence: TTT
tttttctctcagcctttcac

SEQ ID NO: 36111 - DNA, 20 bp, Artificial Sequence
  Description of Artificial Sequence: Synthetic oligonucleotide
  Target: FXN; (+) strand; PAM type: YTN; PAM sequence: TTT
ttttctctcagcctttcaca

SEQ ID NO: 36112 - DNA, 20 bp, Artificial Sequence
  Description of Artificial Sequence: Synthetic oligonucleotide
  Target: FXN; (+) strand; PAM type: YTN; PAM sequence: TTT
tttctctcagcctttcacat

SEQ ID NO: 36113 - DNA, 20 bp, Artificial Sequence
  Description of Artificial Sequence: Synthetic oligonucleotide
  Target: FXN; (+) strand; PAM type: YTN; PAM sequence: TTT
ttctctcagcctttcacatt

SEQ ID NO: 36114 - DNA, 20 bp, Artificial Sequence
  Description of Artificial Sequence: Synthetic oligonucleotide
  Target: FXN; (+) strand; PAM type: YTN; PAM sequence: TTT
tctctcagcctttcacattg

SEQ ID NO: 36115 - DNA, 20 bp, Artificial Sequence
  Description of Artificial Sequence: Synthetic oligonucleotide
  Target: FXN; (+) strand; PAM type: YTN; PAM sequence: TTT
ctctcagcctttcacattgg

SEQ ID NO: 36116 - DNA, 20 bp, Artificial Sequence
  Description of Artificial Sequence: Synthetic oligonucleotide
  Target: FXN; (+) strand; PAM type: YTN; PAM sequence: TTC
tctcagcctttcacattggt

SEQ ID NO: 36117 - DNA, 20 bp, Artificial Sequence
  Description of Artificial Sequence: Synthetic oligonucleotide
  Target: FXN; (+) strand; PAM type: YTN; PAM sequence: CTC
tcagcctttcacattggttc

SEQ ID NO: 36118 - DNA, 20 bp, Artificial Sequence
  Description of Artificial Sequence: Synthetic oligonucleotide
  Target: FXN; (+) strand; PAM type: YTN; PAM sequence: CTC
agcctttcacattggttcaa

SEQ ID NO: 36119 - DNA, 20 bp, Artificial Sequence
  Description of Artificial Sequence: Synthetic oligonucleotide
  Target: FXN; (+) strand; PAM type: YTN; PAM sequence: CTT
tcacattggttcaaaatatc

SEQ ID NO: 36120 - DNA, 20 bp, Artificial Sequence
  Description of Artificial Sequence: Synthetic oligonucleotide
  Target: FXN; (+) strand; PAM type: YTN; PAM sequence: TTT
cacattggttcaaaatatct

SEQ ID NO: 36121 - DNA, 20 bp, Artificial Sequence
  Description of Artificial Sequence: Synthetic oligonucleotide
  Target: FXN; (+) strand; PAM type: YTN; PAM sequence: TTC
acattggttcaaaatatctt

SEQ ID NO: 36122 - DNA, 20 bp, Artificial Sequence
  Description of Artificial Sequence: Synthetic oligonucleotide
  Target: FXN; (+) strand; PAM type: YTN; PAM sequence: TTG
gttcaaaatatctttcatct

SEQ ID NO: 36123 - DNA, 20 bp, Artificial Sequence
  Description of Artificial Sequence: Synthetic oligonucleotide
  Target: FXN; (+) strand; PAM type: YTN; PAM sequence: TTC
aaaatatctttcatctggct

SEQ ID NO: 36124 - DNA, 20 bp, Artificial Sequence
  Description of Artificial Sequence: Synthetic oligonucleotide
  Target: FXN; (+) strand; PAM type: YTN; PAM sequence: CTT
tcatctggctgcatttctga

SEQ ID NO: 36125 - DNA, 20 bp, Artificial Sequence
  Description of Artificial Sequence: Synthetic oligonucleotide
  Target: FXN; (+) strand; PAM type: YTN; PAM sequence: TTT
catctggctgcatttctgat

SEQ ID NO: 36126 - DNA, 20 bp, Artificial Sequence
  Description of Artificial Sequence: Synthetic oligonucleotide
  Target: FXN; (+) strand; PAM type: YTN; PAM sequence: TTC
atctggctgcatttctgatt

SEQ ID NO: 36127 - DNA, 20 bp, Artificial Sequence
  Description of Artificial Sequence: Synthetic oligonucleotide
  Target: FXN; (+) strand; PAM type: YTN; PAM sequence: CTG
gctgcatttctgatttttgt

SEQ ID NO: 36128 - DNA, 20 bp, Artificial Sequence
  Description of Artificial Sequence: Synthetic oligonucleotide
  Target: FXN; (+) strand; PAM type: YTN; PAM sequence: CTG
catttctgatttttgttttg

SEQ ID NO: 36129 - DNA, 20 bp, Artificial Sequence
  Description of Artificial Sequence: Synthetic oligonucleotide
  Target: FXN; (+) strand; PAM type: YTN; PAM sequence: TTT
ctgatttttgttttgttttt

SEQ ID NO: 36130 - DNA, 20 bp, Artificial Sequence
  Description of Artificial Sequence: Synthetic oligonucleotide
  Target: FXN; (+) strand; PAM type: YTN; PAM sequence: TTC
tgatttttgttttgtttttt

SEQ ID NO: 36131 - DNA, 20 bp, Artificial Sequence
  Description of Artificial Sequence: Synthetic oligonucleotide
  Target: FXN; (+) strand; PAM type: YTN; PAM sequence: CTG
atttttgttttgtttttttt

SEQ ID NO: 36132 - DNA, 20 bp, Artificial Sequence
  Description of Artificial Sequence: Synthetic oligonucleotide
  Target: FXN; (+) strand; PAM type: YTN; PAM sequence: TTT
ttgttttgttttttttttct

SEQ ID NO: 36133 - DNA, 20 bp, Artificial Sequence
  Description of Artificial Sequence: Synthetic oligonucleotide
  Target: FXN; (+) strand; PAM type: YTN; PAM sequence: TTT
tgttttgttttttttttctt

SEQ ID NO: 36134 - DNA, 20 bp, Artificial Sequence
  Description of Artificial Sequence: Synthetic oligonucleotide
  Target: FXN; (+) strand; PAM type: YTN; PAM sequence: TTT
gttttgttttttttttctta

SEQ ID NO: 36135 - DNA, 20 bp, Artificial Sequence
  Description of Artificial Sequence: Synthetic oligonucleotide
  Target: FXN; (+) strand; PAM type: YTN; PAM sequence: TTG
ttttgttttttttttcttaa

SEQ ID NO: 36136 - DNA, 20 bp, Artificial Sequence
  Description of Artificial Sequence: Synthetic oligonucleotide
  Target: FXN; (+) strand; PAM type: YTN; PAM sequence: TTT
tgttttttttttcttaattt

SEQ ID NO: 36137 - DNA, 20 bp, Artificial Sequence
  Description of Artificial Sequence: Synthetic oligonucleotide
  Target: FXN; (+) strand; PAM type: YTN; PAM sequence: TTT
gttttttttttcttaatttt

SEQ ID NO: 36138 - DNA, 20 bp, Artificial Sequence
  Description of Artificial Sequence: Synthetic oligonucleotide
  Target: FXN; (+) strand; PAM type: YTN; PAM sequence: TTG
ttttttttttcttaatttta

SEQ ID NO: 36139 - DNA, 20 bp, Artificial Sequence
  Description of Artificial Sequence: Synthetic oligonucleotide
  Target: FXN; (+) strand; PAM type: YTN; PAM sequence: TTT
tttttttcttaattttattt

SEQ ID NO: 36140 - DNA, 20 bp, Artificial Sequence
  Description of Artificial Sequence: Synthetic oligonucleotide
  Target: FXN; (+) strand; PAM type: YTN; PAM sequence: TTT
ttttttcttaattttattta

SEQ ID NO: 36141 - DNA, 20 bp, Artificial Sequence
  Description of Artificial Sequence: Synthetic oligonucleotide
  Target: FXN; (+) strand; PAM type: YTN; PAM sequence: TTT
tttttcttaattttatttat

SEQ ID NO: 36142 - DNA, 20 bp, Artificial Sequence
  Description of Artificial Sequence: Synthetic oligonucleotide
  Target: FXN; (+) strand; PAM type: YTN; PAM sequence: TTT
ttttcttaattttatttatt

SEQ ID NO: 36143 - DNA, 20 bp, Artificial Sequence
  Description of Artificial Sequence: Synthetic oligonucleotide
  Target: FXN; (+) strand; PAM type: YTN; PAM sequence: TTT
tttcttaattttatttattt

SEQ ID NO: 36144 - DNA, 20 bp, Artificial Sequence
  Description of Artificial Sequence: Synthetic oligonucleotide
  Target: FXN; (+) strand; PAM type: YTN; PAM sequence: TTT
ttcttaattttatttatttt

SEQ ID NO: 36145 - DNA, 20 bp, Artificial Sequence
  Description of Artificial Sequence: Synthetic oligonucleotide
  Target: FXN; (+) strand; PAM type: YTN; PAM sequence: TTT
tcttaattttatttattttt

SEQ ID NO: 36146 - DNA, 20 bp, Artificial Sequence
  Description of Artificial Sequence: Synthetic oligonucleotide
  Target: FXN; (+) strand; PAM type: YTN; PAM sequence: TTT
cttaattttatttattttta

SEQ ID NO: 36147 - DNA, 20 bp, Artificial Sequence
  Description of Artificial Sequence: Synthetic oligonucleotide
  Target: FXN; (+) strand; PAM type: YTN; PAM sequence: TTC
ttaattttatttatttttaa

SEQ ID NO: 36148 - DNA, 20 bp, Artificial Sequence
  Description of Artificial Sequence: Synthetic oligonucleotide
  Target: FXN; (+) strand; PAM type: YTN; PAM sequence: CTT
aattttatttatttttaatt

SEQ ID NO: 36149 - DNA, 20 bp, Artificial Sequence
  Description of Artificial Sequence: Synthetic oligonucleotide
  Target: FXN; (+) strand; PAM type: YTN; PAM sequence: TTA
attttatttatttttaatta

SEQ ID NO: 36150 - DNA, 20 bp, Artificial Sequence
  Description of Artificial Sequence: Synthetic oligonucleotide
  Target: FXN; (+) strand; PAM type: YTN; PAM sequence: TTT
tatttatttttaattaaaaa

SEQ ID NO: 36151 - DNA, 20 bp, Artificial Sequence
  Description of Artificial Sequence: Synthetic oligonucleotide
  Target: FXN; (+) strand; PAM type: YTN; PAM sequence: TTT
atttatttttaattaaaaat

SEQ ID NO: 36152 - DNA, 20 bp, Artificial Sequence
  Description of Artificial Sequence: Synthetic oligonucleotide
  Target: FXN; (+) strand; PAM type: YTN; PAM sequence: TTA
tttatttttaattaaaaata

SEQ ID NO: 36153 - DNA, 20 bp, Artificial Sequence
  Description of Artificial Sequence: Synthetic oligonucleotide
  Target: FXN; (+) strand; PAM type: YTN; PAM sequence: TTT
atttttaattaaaaataatt

SEQ ID NO: 36154 - DNA, 20 bp, Artificial Sequence
  Description of Artificial Sequence: Synthetic oligonucleotide
  Target: FXN; (+) strand; PAM type: YTN; PAM sequence: TTA
tttttaattaaaaataattt

SEQ ID NO: 36155 - DNA, 20 bp, Artificial Sequence
  Description of Artificial Sequence: Synthetic oligonucleotide
  Target: FXN; (+) strand; PAM type: YTN; PAM sequence: TTT
ttaattaaaaataatttttt

SEQ ID NO: 36156 - DNA, 20 bp, Artificial Sequence
  Description of Artificial Sequence: Synthetic oligonucleotide
  Target: FXN; (+) strand; PAM type: YTN; PAM sequence: TTT
taattaaaaataattttttt

SEQ ID NO: 36157 - DNA, 20 bp, Artificial Sequence
  Description of Artificial Sequence: Synthetic oligonucleotide
  Target: FXN; (+) strand; PAM type: YTN; PAM sequence: TTT
aattaaaaataatttttttt

SEQ ID NO: 36158 - DNA, 20 bp, Artificial Sequence
  Description of Artificial Sequence: Synthetic oligonucleotide
  Target: FXN; (+) strand; PAM type: YTN; PAM sequence: TTA
attaaaaataattttttttg

SEQ ID NO: 36159 - DNA, 20 bp, Artificial Sequence
  Description of Artificial Sequence: Synthetic oligonucleotide
  Target: FXN; (+) strand; PAM type: YTN; PAM sequence: TTA
aaaataattttttttgtcaa

SEQ ID NO: 36160 - DNA, 20 bp, Artificial Sequence
  Description of Artificial Sequence: Synthetic oligonucleotide
  Target: FXN; (+) strand; PAM type: YTN; PAM sequence: TTT
tttttgtcaacatggggtct

SEQ ID NO: 36161 - DNA, 20 bp, Artificial Sequence
  Description of Artificial Sequence: Synthetic oligonucleotide
  Target: FXN; (+) strand; PAM type: YTN; PAM sequence: TTT
ttttgtcaacatggggtctc

SEQ ID NO: 36162 - DNA, 20 bp, Artificial Sequence
  Description of Artificial Sequence: Synthetic oligonucleotide
  Target: FXN; (+) strand; PAM type: YTN; PAM sequence: TTT
tttgtcaacatggggtctca

SEQ ID NO: 36163 - DNA, 20 bp, Artificial Sequence
  Description of Artificial Sequence: Synthetic oligonucleotide
  Target: FXN; (+) strand; PAM type: YTN; PAM sequence: TTT
ttgtcaacatggggtctcac

SEQ ID NO: 36164 - DNA, 20 bp, Artificial Sequence
  Description of Artificial Sequence: Synthetic oligonucleotide
  Target: FXN; (+) strand; PAM type: YTN; PAM sequence: TTT
tgtcaacatggggtctcact

SEQ ID NO: 36165 - DNA, 20 bp, Artificial Sequence
  Description of Artificial Sequence: Synthetic oligonucleotide
  Target: FXN; (+) strand; PAM type: YTN; PAM sequence: TTT
gtcaacatggggtctcactt

SEQ ID NO: 36166 - DNA, 20 bp, Artificial Sequence
  Description of Artificial Sequence: Synthetic oligonucleotide
  Target: FXN; (+) strand; PAM type: YTN; PAM sequence: TTG
tcaacatggggtctcacttt

SEQ ID NO: 36167 - DNA, 20 bp, Artificial Sequence
  Description of Artificial Sequence: Synthetic oligonucleotide
  Target: FXN; (+) strand; PAM type: YTN; PAM sequence: CTC
actttgttgcctaggttggt

SEQ ID NO: 36168 - DNA, 20 bp, Artificial Sequence
  Description of Artificial Sequence: Synthetic oligonucleotide
  Target: FXN; (+) strand; PAM type: YTN; PAM sequence: CTT
tgttgcctaggttggtctga

SEQ ID NO: 36169 - DNA, 20 bp, Artificial Sequence
  Description of Artificial Sequence: Synthetic oligonucleotide
  Target: FXN; (+) strand; PAM type: YTN; PAM sequence: TTT
gttgcctaggttggtctgaa

SEQ ID NO: 36170 - DNA, 20 bp, Artificial Sequence
  Description of Artificial Sequence: Synthetic oligonucleotide
  Target: FXN; (+) strand; PAM type: YTN; PAM sequence: TTG
ttgcctaggttggtctgaaa

SEQ ID NO: 36171 - DNA, 20 bp, Artificial Sequence
  Description of Artificial Sequence: Synthetic oligonucleotide
  Target: FXN; (+) strand; PAM type: YTN; PAM sequence: TTG
cctaggttggtctgaaactc

SEQ ID NO: 36172 - DNA, 20 bp, Artificial Sequence
  Description of Artificial Sequence: Synthetic oligonucleotide
  Target: FXN; (+) strand; PAM type: YTN; PAM sequence: CTA
ggttggtctgaaactcgtgg

SEQ ID NO: 36173 - DNA, 20 bp, Artificial Sequence
  Description of Artificial Sequence: Synthetic oligonucleotide
  Target: FXN; (+) strand; PAM type: YTN; PAM sequence: TTG
gtctgaaactcgtggcttca

SEQ ID NO: 36174 - DNA, 20 bp, Artificial Sequence
  Description of Artificial Sequence: Synthetic oligonucleotide
  Target: FXN; (+) strand; PAM type: YTN; PAM sequence: CTG
aaactcgtggcttcaagcaa

SEQ ID NO: 36175 - DNA, 20 bp, Artificial Sequence
  Description of Artificial Sequence: Synthetic oligonucleotide
  Target: FXN; (+) strand; PAM type: YTN; PAM sequence: CTC
gtggcttcaagcaatcctcc

SEQ ID NO: 36176 - DNA, 20 bp, Artificial Sequence
  Description of Artificial Sequence: Synthetic oligonucleotide
  Target: FXN; (+) strand; PAM type: YTN; PAM sequence: CTT
caagcaatcctcccacatca

SEQ ID NO: 36177 - DNA, 20 bp, Artificial Sequence
  Description of Artificial Sequence: Synthetic oligonucleotide
  Target: FXN; (+) strand; PAM type: YTN; PAM sequence: TTC
aagcaatcctcccacatcag

SEQ ID NO: 36178 - DNA, 20 bp, Artificial Sequence
  Description of Artificial Sequence: Synthetic oligonucleotide
  Target: FXN; (+) strand; PAM type: YTN; PAM sequence: CTC
ccacatcagcctcccaaagt

SEQ ID NO: 36179 - DNA, 20 bp, Artificial Sequence
  Description of Artificial Sequence: Synthetic oligonucleotide
  Target: FXN; (+) strand; PAM type: YTN; PAM sequence: CTC
ccaaagtgctggggttatgg

SEQ ID NO: 36180 - DNA, 20 bp, Artificial Sequence
  Description of Artificial Sequence: Synthetic oligonucleotide
  Target: FXN; (+) strand; PAM type: YTN; PAM sequence: CTG
gggttatgggtgtgagccac

SEQ ID NO: 36181 - DNA, 20 bp, Artificial Sequence
  Description of Artificial Sequence: Synthetic oligonucleotide
  Target: FXN; (+) strand; PAM type: YTN; PAM sequence: TTA
tgggtgtgagccactgcagc

SEQ ID NO: 36182 - DNA, 20 bp, Artificial Sequence
  Description of Artificial Sequence: Synthetic oligonucleotide
  Target: FXN; (+) strand; PAM type: YTN; PAM sequence: CTG
cagcagcctgttttttttgt

SEQ ID NO: 36183 - DNA, 20 bp, Artificial Sequence
  Description of Artificial Sequence: Synthetic oligonucleotide
  Target: FXN; (+) strand; PAM type: YTN; PAM sequence: CTG
ttttttttgtttgtttgttt

SEQ ID NO: 36184 - DNA, 20 bp, Artificial Sequence
  Description of Artificial Sequence: Synthetic oligonucleotide
  Target: FXN; (+) strand; PAM type: YTN; PAM sequence: TTT
tttttgtttgtttgtttttt

SEQ ID NO: 36185 - DNA, 20 bp, Artificial Sequence
  Description of Artificial Sequence: Synthetic oligonucleotide
  Target: FXN; (+) strand; PAM type: YTN; PAM sequence: TTT
ttttgtttgtttgttttttt

SEQ ID NO: 36186 - DNA, 20 bp, Artificial Sequence
  Description of Artificial Sequence: Synthetic oligonucleotide
  Target: FXN; (+) strand; PAM type: YTN; PAM sequence: TTT
tttgtttgtttgtttttttt

SEQ ID NO: 36187 - DNA, 20 bp, Artificial Sequence
  Description of Artificial Sequence: Synthetic oligonucleotide
  Target: FXN; (+) strand; PAM type: YTN; PAM sequence: TTT
ttgtttgtttgtttttttta

SEQ ID NO: 36188 - DNA, 20 bp, Artificial Sequence
  Description of Artificial Sequence: Synthetic oligonucleotide
  Target: FXN; (+) strand; PAM type: YTN; PAM sequence: TTT
tgtttgtttgttttttttaa

SEQ ID NO: 36189 - DNA, 20 bp, Artificial Sequence
  Description of Artificial Sequence: Synthetic oligonucleotide
  Target: FXN; (+) strand; PAM type: YTN; PAM sequence: TTT
gtttgtttgttttttttaat

SEQ ID NO: 36190 - DNA, 20 bp, Artificial Sequence
  Description of Artificial Sequence: Synthetic oligonucleotide
  Target: FXN; (+) strand; PAM type: YTN; PAM sequence: TTG
tttgtttgttttttttaatt

SEQ ID NO: 36191 - DNA, 20 bp, Artificial Sequence
  Description of Artificial Sequence: Synthetic oligonucleotide
  Target: FXN; (+) strand; PAM type: YTN; PAM sequence: TTT
gtttgttttttttaatttga

SEQ ID NO: 36192 - DNA, 20 bp, Artificial Sequence
  Description of Artificial Sequence: Synthetic oligonucleotide
  Target: FXN; (+) strand; PAM type: YTN; PAM sequence: TTG
tttgttttttttaatttgac

SEQ ID NO: 36193 - DNA, 20 bp, Artificial Sequence
  Description of Artificial Sequence: Synthetic oligonucleotide
  Target: FXN; (+) strand; PAM type: YTN; PAM sequence: TTT
gttttttttaatttgacaag

SEQ ID NO: 36194 - DNA, 20 bp, Artificial Sequence
  Description of Artificial Sequence: Synthetic oligonucleotide
  Target: FXN; (+) strand; PAM type: YTN; PAM sequence: TTG
ttttttttaatttgacaagt

SEQ ID NO: 36195 - DNA, 20 bp, Artificial Sequence
  Description of Artificial Sequence: Synthetic oligonucleotide
  Target: FXN; (+) strand; PAM type: YTN; PAM sequence: TTT
tttttaatttgacaagtttt

SEQ ID NO: 36196 - DNA, 20 bp, Artificial Sequence
  Description of Artificial Sequence: Synthetic oligonucleotide
  Target: FXN; (+) strand; PAM type: YTN; PAM sequence: TTT
ttttaatttgacaagttttc

SEQ ID NO: 36197 - DNA, 20 bp, Artificial Sequence
  Description of Artificial Sequence: Synthetic oligonucleotide
  Target: FXN; (+) strand; PAM type: YTN; PAM sequence: TTT
tttaatttgacaagttttca

SEQ ID NO: 36198 - DNA, 20 bp, Artificial Sequence
  Description of Artificial Sequence: Synthetic oligonucleotide
  Target: FXN; (+) strand; PAM type: YTN; PAM sequence: TTT
ttaatttgacaagttttcag

SEQ ID NO: 36199 - DNA, 20 bp, Artificial Sequence
  Description of Artificial Sequence: Synthetic oligonucleotide
  Target: FXN; (+) strand; PAM type: YTN; PAM sequence: TTT
taatttgacaagttttcagg

SEQ ID NO: 36200 - DNA, 20 bp, Artificial Sequence
  Description of Artificial Sequence: Synthetic oligonucleotide
  Target: FXN; (+) strand; PAM type: YTN; PAM sequence: TTT
aatttgacaagttttcaggt

SEQ ID NO: 36201 - DNA, 20 bp, Artificial Sequence
  Description of Artificial Sequence: Synthetic oligonucleotide
  Target: FXN; (+) strand; PAM type: YTN; PAM sequence: TTA
atttgacaagttttcaggtc

SEQ ID NO: 36202 - DNA, 20 bp, Artificial Sequence
  Description of Artificial Sequence: Synthetic oligonucleotide
  Target: FXN; (+) strand; PAM type: YTN; PAM sequence: TTT
gacaagttttcaggtcctgt

SEQ ID NO: 36203 - DNA, 20 bp, Artificial Sequence
  Description of Artificial Sequence: Synthetic oligonucleotide
  Target: FXN; (+) strand; PAM type: YTN; PAM sequence: TTG
acaagttttcaggtcctgtg

SEQ ID NO: 36204 - DNA, 20 bp, Artificial Sequence
  Description of Artificial Sequence: Synthetic oligonucleotide
  Target: FXN; (+) strand; PAM type: YTN; PAM sequence: TTT
tcaggtcctgtgaaatcagc

SEQ ID NO: 36205 - DNA, 20 bp, Artificial Sequence
  Description of Artificial Sequence: Synthetic oligonucleotide
  Target: FXN; (+) strand; PAM type: YTN; PAM sequence: TTT
caggtcctgtgaaatcagca

SEQ ID NO: 36206 - DNA, 20 bp, Artificial Sequence
  Description of Artificial Sequence: Synthetic oligonucleotide
  Target: FXN; (+) strand; PAM type: YTN; PAM sequence: TTC
aggtcctgtgaaatcagcag

SEQ ID NO: 36207 - DNA, 20 bp, Artificial Sequence
  Description of Artificial Sequence: Synthetic oligonucleotide
  Target: FXN; (+) strand; PAM type: YTN; PAM sequence: CTG
tgaaatcagcagtcttacct

SEQ ID NO: 36208 - DNA, 20 bp, Artificial Sequence
  Description of Artificial Sequence: Synthetic oligonucleotide
  Target: FXN; (+) strand; PAM type: YTN; PAM sequence: CTT
acctcccaccttgcgcaccc

SEQ ID NO: 36209 - DNA, 20 bp, Artificial Sequence
  Description of Artificial Sequence: Synthetic oligonucleotide
  Target: FXN; (+) strand; PAM type: YTN; PAM sequence: TTA
cctcccaccttgcgcaccct

SEQ ID NO: 36210 - DNA, 20 bp, Artificial Sequence
  Description of Artificial Sequence: Synthetic oligonucleotide
  Target: FXN; (+) strand; PAM type: YTN; PAM sequence: CTC
ccaccttgcgcaccctgagg

SEQ ID NO: 36211 - DNA, 20 bp, Artificial Sequence
  Description of Artificial Sequence: Synthetic oligonucleotide
  Target: FXN; (+) strand; PAM type: YTN; PAM sequence: CTT
gcgcaccctgaggaggttgc

SEQ ID NO: 36212 - DNA, 20 bp, Artificial Sequence
  Description of Artificial Sequence: Synthetic oligonucleotide
  Target: FXN; (+) strand; PAM type: YTN; PAM sequence: TTG
cgcaccctgaggaggttgca

SEQ ID NO: 36213 - DNA, 20 bp, Artificial Sequence
  Description of Artificial Sequence: Synthetic oligonucleotide
  Target: FXN; (+) strand; PAM type: YTN; PAM sequence: CTG
aggaggttgcagaataaagg

SEQ ID NO: 36214 - DNA, 20 bp, Artificial Sequence
  Description of Artificial Sequence: Synthetic oligonucleotide
  Target: FXN; (+) strand; PAM type: YTN; PAM sequence: TTG
cagaataaaggagaattcta

SEQ ID NO: 36215 - DNA, 20 bp, Artificial Sequence
  Description of Artificial Sequence: Synthetic oligonucleotide
  Target: FXN; (+) strand; PAM type: YTN; PAM sequence: TTC
tagggacacgtgggcatcag

SEQ ID NO: 36216 - DNA, 20 bp, Artificial Sequence
  Description of Artificial Sequence: Synthetic oligonucleotide
  Target: FXN; (+) strand; PAM type: YTN; PAM sequence: CTA
gggacacgtgggcatcagtg

SEQ ID NO: 36217 - DNA, 20 bp, Artificial Sequence
  Description of Artificial Sequence: Synthetic oligonucleotide
  Target: FXN; (+) strand; PAM type: YTN; PAM sequence: CTG
tgctcagagcacctcaggca

SEQ ID NO: 36218 - DNA, 20 bp, Artificial Sequence
  Description of Artificial Sequence: Synthetic oligonucleotide
  Target: FXN; (+) strand; PAM type: YTN; PAM sequence: CTC
agagcacctcaggcagtgtg

SEQ ID NO: 36219 - DNA, 20 bp, Artificial Sequence
  Description of Artificial Sequence: Synthetic oligonucleotide
  Target: FXN; (+) strand; PAM type: YTN; PAM sequence: CTC
aggcagtgtggaggggtcta

SEQ ID NO: 36220 - DNA, 20 bp, Artificial Sequence
  Description of Artificial Sequence: Synthetic oligonucleotide
  Target: FXN; (+) strand; PAM type: YTN; PAM sequence: CTA
gaggttactcaggctctgcc

SEQ ID NO: 36221 - DNA, 20 bp, Artificial Sequence
  Description of Artificial Sequence: Synthetic oligonucleotide
  Target: FXN; (+) strand; PAM type: YTN; PAM sequence: TTA
ctcaggctctgcctggcaac

SEQ ID NO: 36222 - DNA, 20 bp, Artificial Sequence
  Description of Artificial Sequence: Synthetic oligonucleotide
  Target: FXN; (+) strand; PAM type: YTN; PAM sequence: CTC
aggctctgcctggcaacccg

SEQ ID NO: 36223 - DNA, 20 bp, Artificial Sequence
  Description of Artificial Sequence: Synthetic oligonucleotide
  Target: FXN; (+) strand; PAM type: YTN; PAM sequence: CTC
tgcctggcaacccgatagca

SEQ ID NO: 36224 - DNA, 20 bp, Artificial Sequence
  Description of Artificial Sequence: Synthetic oligonucleotide
  Target: FXN; (+) strand; PAM type: YTN; PAM sequence: CTG
cctggcaacccgatagcagt

SEQ ID NO: 36225 - DNA, 20 bp, Artificial Sequence
  Description of Artificial Sequence: Synthetic oligonucleotide
  Target: FXN; (+) strand; PAM type: YTN; PAM sequence: CTG
gcaacccgatagcagtatca

SEQ ID NO: 36226 - DNA, 20 bp, Artificial Sequence
  Description of Artificial Sequence: Synthetic oligonucleotide
  Target: FXN; (+) strand; PAM type: YTN; PAM sequence: CTT
gggcttggtgtggtttatta

SEQ ID NO: 36227 - DNA, 20 bp, Artificial Sequence
  Description of Artificial Sequence: Synthetic oligonucleotide
  Target: FXN; (+) strand; PAM type: YTN; PAM sequence: TTG
ggcttggtgtggtttattag

SEQ ID NO: 36228 - DNA, 20 bp, Artificial Sequence
  Description of Artificial Sequence: Synthetic oligonucleotide
  Target: FXN; (+) strand; PAM type: YTN; PAM sequence: CTT
ggtgtggtttattagtcctt

SEQ ID NO: 36229 - DNA, 20 bp, Artificial Sequence
  Description of Artificial Sequence: Synthetic oligonucleotide
  Target: FXN; (+) strand; PAM type: YTN; PAM sequence: TTG
gtgtggtttattagtccttt

SEQ ID NO: 36230 - DNA, 20 bp, Artificial Sequence
  Description of Artificial Sequence: Synthetic oligonucleotide
  Target: FXN; (+) strand; PAM type: YTN; PAM sequence: TTT
attagtccttttcctgtgac

SEQ ID NO: 36231 - DNA, 20 bp, Artificial Sequence
  Description of Artificial Sequence: Synthetic oligonucleotide
  Target: FXN; (+) strand; PAM type: YTN; PAM sequence: TTA
ttagtccttttcctgtgacc

SEQ ID NO: 36232 - DNA, 20 bp, Artificial Sequence
  Description of Artificial Sequence: Synthetic oligonucleotide
  Target: FXN; (+) strand; PAM type: YTN; PAM sequence: TTA
gtccttttcctgtgaccctg

SEQ ID NO: 36233 - DNA, 20 bp, Artificial Sequence
  Description of Artificial Sequence: Synthetic oligonucleotide
  Target: FXN; (+) strand; PAM type: YTN; PAM sequence: CTT
ttcctgtgaccctgatggtt

SEQ ID NO: 36234 - DNA, 20 bp, Artificial Sequence
  Description of Artificial Sequence: Synthetic oligonucleotide
  Target: FXN; (+) strand; PAM type: YTN; PAM sequence: TTT
tcctgtgaccctgatggttt

SEQ ID NO: 36235 - DNA, 20 bp, Artificial Sequence
  Description of Artificial Sequence: Synthetic oligonucleotide
  Target: FXN; (+) strand; PAM type: YTN; PAM sequence: TTT
cctgtgaccctgatggtttg

SEQ ID NO: 36236 - DNA, 20 bp, Artificial Sequence
  Description of Artificial Sequence: Synthetic oligonucleotide
  Target: FXN; (+) strand; PAM type: YTN; PAM sequence: TTC
ctgtgaccctgatggtttgg

SEQ ID NO: 36237 - DNA, 20 bp, Artificial Sequence
  Description of Artificial Sequence: Synthetic oligonucleotide
  Target: FXN; (+) strand; PAM type: YTN; PAM sequence: CTG
tgaccctgatggtttggttc

SEQ ID NO: 36238 - DNA, 20 bp, Artificial Sequence
  Description of Artificial Sequence: Synthetic oligonucleotide
  Target: FXN; (+) strand; PAM type: YTN; PAM sequence: CTG
atggtttggttcactcattt

SEQ ID NO: 36239 - DNA, 20 bp, Artificial Sequence
  Description of Artificial Sequence: Synthetic oligonucleotide
  Target: FXN; (+) strand; PAM type: YTN; PAM sequence: TTT
ggttcactcatttttatctc

SEQ ID NO: 36240 - DNA, 20 bp, Artificial Sequence
  Description of Artificial Sequence: Synthetic oligonucleotide
  Target: FXN; (+) strand; PAM type: YTN; PAM sequence: TTG
gttcactcatttttatctcc

SEQ ID NO: 36241 - DNA, 20 bp, Artificial Sequence
  Description of Artificial Sequence: Synthetic oligonucleotide
  Target: FXN; (+) strand; PAM type: YTN; PAM sequence: TTC
actcatttttatctccatac

SEQ ID NO: 36242 - DNA, 20 bp, Artificial Sequence
  Description of Artificial Sequence: Synthetic oligonucleotide
  Target: FXN; (+) strand; PAM type: YTN; PAM sequence: CTC
atttttatctccatactggg

SEQ ID NO: 36243 - DNA, 20 bp, Artificial Sequence
  Description of Artificial Sequence: Synthetic oligonucleotide
  Target: FXN; (+) strand; PAM type: YTN; PAM sequence: TTT
ttatctccatactgggaaca

SEQ ID NO: 36244 - DNA, 20 bp, Artificial Sequence
  Description of Artificial Sequence: Synthetic oligonucleotide
  Target: FXN; (+) strand; PAM type: YTN; PAM sequence: TTT
tatctccatactgggaacag

SEQ ID NO: 36245 - DNA, 20 bp, Artificial Sequence
  Description of Artificial Sequence: Synthetic oligonucleotide
  Target: FXN; (+) strand; PAM type: YTN; PAM sequence: TTT
atctccatactgggaacagg

SEQ ID NO: 36246 - DNA, 20 bp, Artificial Sequence
  Description of Artificial Sequence: Synthetic oligonucleotide
  Target: FXN; (+) strand; PAM type: YTN; PAM sequence: TTA
tctccatactgggaacaggt

SEQ ID NO: 36247 - DNA, 20 bp, Artificial Sequence
  Description of Artificial Sequence: Synthetic oligonucleotide
  Target: FXN; (+) strand; PAM type: YTN; PAM sequence: CTC
catactgggaacaggttcaa

SEQ ID NO: 36248 - DNA, 20 bp, Artificial Sequence
  Description of Artificial Sequence: Synthetic oligonucleotide
  Target: FXN; (+) strand; PAM type: YTN; PAM sequence: CTG
ggaacaggttcaagccccag

SEQ ID NO: 36249 - DNA, 20 bp, Artificial Sequence
  Description of Artificial Sequence: Synthetic oligonucleotide
  Target: FXN; (+) strand; PAM type: YTN; PAM sequence: TTC
aagccccagcatttggttga

SEQ ID NO: 36250 - DNA, 20 bp, Artificial Sequence
  Description of Artificial Sequence: Synthetic oligonucleotide
  Target: FXN; (+) strand; PAM type: YTN; PAM sequence: TTT
ggttgataatgcaggaatcc

SEQ ID NO: 36251 - DNA, 20 bp, Artificial Sequence
  Description of Artificial Sequence: Synthetic oligonucleotide
  Target: FXN; (+) strand; PAM type: YTN; PAM sequence: TTG
gttgataatgcaggaatcct

SEQ ID NO: 36252 - DNA, 20 bp, Artificial Sequence
  Description of Artificial Sequence: Synthetic oligonucleotide
  Target: FXN; (+) strand; PAM type: YTN; PAM sequence: TTG
ataatgcaggaatccttgat

SEQ ID NO: 36253 - DNA, 20 bp, Artificial Sequence
  Description of Artificial Sequence: Synthetic oligonucleotide
  Target: FXN; (+) strand; PAM type: YTN; PAM sequence: CTT
gatacttttattgcccaagc

SEQ ID NO: 36254 - DNA, 20 bp, Artificial Sequence
  Description of Artificial Sequence: Synthetic oligonucleotide
  Target: FXN; (+) strand; PAM type: YTN; PAM sequence: TTG
atacttttattgcccaagct

SEQ ID NO: 36255 - DNA, 20 bp, Artificial Sequence
  Description of Artificial Sequence: Synthetic oligonucleotide
  Target: FXN; (+) strand; PAM type: YTN; PAM sequence: CTT
ttattgcccaagcttccctt

SEQ ID NO: 36256 - DNA, 20 bp, Artificial Sequence
  Description of Artificial Sequence: Synthetic oligonucleotide
  Target: FXN; (+) strand; PAM type: YTN; PAM sequence: TTT
tattgcccaagcttcccttc

SEQ ID NO: 36257 - DNA, 20 bp, Artificial Sequence
  Description of Artificial Sequence: Synthetic oligonucleotide
  Target: FXN; (+) strand; PAM type: YTN; PAM sequence: TTT
attgcccaagcttcccttcc

SEQ ID NO: 36258 - DNA, 20 bp, Artificial Sequence
  Description of Artificial Sequence: Synthetic oligonucleotide
  Target: FXN; (+) strand; PAM type: YTN; PAM sequence: TTA
ttgcccaagcttcccttcct

SEQ ID NO: 36259 - DNA, 20 bp, Artificial Sequence
  Description of Artificial Sequence: Synthetic oligonucleotide
  Target: FXN; (+) strand; PAM type: YTN; PAM sequence: TTG
cccaagcttcccttcctggt

SEQ ID NO: 36260 - DNA, 20 bp, Artificial Sequence
  Description of Artificial Sequence: Synthetic oligonucleotide
  Target: FXN; (+) strand; PAM type: YTN; PAM sequence: CTT
cccttcctggtgacctcatc

SEQ ID NO: 36261 - DNA, 20 bp, Artificial Sequence
  Description of Artificial Sequence: Synthetic oligonucleotide
  Target: FXN; (+) strand; PAM type: YTN; PAM sequence: TTC
ccttcctggtgacctcatcc

SEQ ID NO: 36262 - DNA, 20 bp, Artificial Sequence
  Description of Artificial Sequence: Synthetic oligonucleotide
  Target: FXN; (+) strand; PAM type: YTN; PAM sequence: CTT
cctggtgacctcatcctagc

SEQ ID NO: 36263 - DNA, 20 bp, Artificial Sequence
  Description of Artificial Sequence: Synthetic oligonucleotide
  Target: FXN; (+) strand; PAM type: YTN; PAM sequence: TTC
ctggtgacctcatcctagcc

SEQ ID NO: 36264 - DNA, 20 bp, Artificial Sequence
  Description of Artificial Sequence: Synthetic oligonucleotide
  Target: FXN; (+) strand; PAM type: YTN; PAM sequence: CTG
gtgacctcatcctagcctca

SEQ ID NO: 36265 - DNA, 20 bp, Artificial Sequence
  Description of Artificial Sequence: Synthetic oligonucleotide
  Target: FXN; (+) strand; PAM type: YTN; PAM sequence: CTC
atcctagcctcagtctttgg

SEQ ID NO: 36266 - DNA, 20 bp, Artificial Sequence
  Description of Artificial Sequence: Synthetic oligonucleotide
  Target: FXN; (+) strand; PAM type: YTN; PAM sequence: CTA
gcctcagtctttggaaaagc

SEQ ID NO: 36267 - DNA, 20 bp, Artificial Sequence
  Description of Artificial Sequence: Synthetic oligonucleotide
  Target: FXN; (+) strand; PAM type: YTN; PAM sequence: CTC
agtctttggaaaagccctcc

SEQ ID NO: 36268 - DNA, 20 bp, Artificial Sequence
  Description of Artificial Sequence: Synthetic oligonucleotide
  Target: FXN; (+) strand; PAM type: YTN; PAM sequence: CTT
tggaaaagccctccttgagt

SEQ ID NO: 36269 - DNA, 20 bp, Artificial Sequence
  Description of Artificial Sequence: Synthetic oligonucleotide
  Target: FXN; (+) strand; PAM type: YTN; PAM sequence: TTT
ggaaaagccctccttgagtg

SEQ ID NO: 36270 - DNA, 20 bp, Artificial Sequence
  Description of Artificial Sequence: Synthetic oligonucleotide
  Target: FXN; (+) strand; PAM type: YTN; PAM sequence: TTG
gaaaagccctccttgagtgc

SEQ ID NO: 36271 - DNA, 20 bp, Artificial Sequence
  Description of Artificial Sequence: Synthetic oligonucleotide
  Target: FXN; (+) strand; PAM type: YTN; PAM sequence: CTC
cttgagtgctcaggcagact

SEQ ID NO: 36272 - DNA, 20 bp, Artificial Sequence
  Description of Artificial Sequence: Synthetic oligonucleotide
  Target: FXN; (+) strand; PAM type: YTN; PAM sequence: CTT
gagtgctcaggcagactcag

SEQ ID NO: 36273 - DNA, 20 bp, Artificial Sequence
  Description of Artificial Sequence: Synthetic oligonucleotide
  Target: FXN; (+) strand; PAM type: YTN; PAM sequence: TTG
agtgctcaggcagactcagg

SEQ ID NO: 36274 - DNA, 20 bp, Artificial Sequence
  Description of Artificial Sequence: Synthetic oligonucleotide
  Target: FXN; (+) strand; PAM type: YTN; PAM sequence: CTC
aggcagactcaggtgccctt

SEQ ID NO: 36275 - DNA, 20 bp, Artificial Sequence
  Description of Artificial Sequence: Synthetic oligonucleotide
  Target: FXN; (+) strand; PAM type: YTN; PAM sequence: CTC
aggtgccctttcttctgggc

SEQ ID NO: 36276 - DNA, 20 bp, Artificial Sequence
  Description of Artificial Sequence: Synthetic oligonucleotide
  Target: FXN; (+) strand; PAM type: YTN; PAM sequence: CTT
tcttctgggctcccatgcac

SEQ ID NO: 36277 - DNA, 20 bp, Artificial Sequence
  Description of Artificial Sequence: Synthetic oligonucleotide
  Target: FXN; (+) strand; PAM type: YTN; PAM sequence: TTT
cttctgggctcccatgcact

SEQ ID NO: 36278 - DNA, 20 bp, Artificial Sequence
  Description of Artificial Sequence: Synthetic oligonucleotide
  Target: FXN; (+) strand; PAM type: YTN; PAM sequence: TTC
ttctgggctcccatgcactc

SEQ ID NO: 36279 - DNA, 20 bp, Artificial Sequence
  Description of Artificial Sequence: Synthetic oligonucleotide
  Target: FXN; (+) strand; PAM type: YTN; PAM sequence: CTT
ctgggctcccatgcactctg

SEQ ID NO: 36280 - DNA, 20 bp, Artificial Sequence
  Description of Artificial Sequence: Synthetic oligonucleotide
  Target: FXN; (+) strand; PAM type: YTN; PAM sequence: TTC
tgggctcccatgcactctgt

SEQ ID NO: 36281 - DNA, 20 bp, Artificial Sequence
  Description of Artificial Sequence: Synthetic oligonucleotide
  Target: FXN; (+) strand; PAM type: YTN; PAM sequence: CTG
ggctcccatgcactctgttc

SEQ ID NO: 36282 - DNA, 20 bp, Artificial Sequence
  Description of Artificial Sequence: Synthetic oligonucleotide
  Target: FXN; (+) strand; PAM type: YTN; PAM sequence: CTC
ccatgcactctgttcttacc

SEQ ID NO: 36283 - DNA, 20 bp, Artificial Sequence
  Description of Artificial Sequence: Synthetic oligonucleotide
  Target: FXN; (+) strand; PAM type: YTN; PAM sequence: CTC
tgttcttacctccatcaggg

SEQ ID NO: 36284 - DNA, 20 bp, Artificial Sequence
  Description of Artificial Sequence: Synthetic oligonucleotide
  Target: FXN; (+) strand; PAM type: YTN; PAM sequence: CTG
ttcttacctccatcagggtg

SEQ ID NO: 36285 - DNA, 20 bp, Artificial Sequence
  Description of Artificial Sequence: Synthetic oligonucleotide
  Target: FXN; (+) strand; PAM type: YTN; PAM sequence: TTC
ttacctccatcagggtgcca

SEQ ID NO: 36286 - DNA, 20 bp, Artificial Sequence
  Description of Artificial Sequence: Synthetic oligonucleotide
  Target: FXN; (+) strand; PAM type: YTN; PAM sequence: CTT
acctccatcagggtgccaca

SEQ ID NO: 36287 - DNA, 20 bp, Artificial Sequence
  Description of Artificial Sequence: Synthetic oligonucleotide
  Target: FXN; (+) strand; PAM type: YTN; PAM sequence: TTA
cctccatcagggtgccacat

SEQ ID NO: 36288 - DNA, 20 bp, Artificial Sequence
  Description of Artificial Sequence: Synthetic oligonucleotide
  Target: FXN; (+) strand; PAM type: YTN; PAM sequence: CTC
catcagggtgccacatgcac

SEQ ID NO: 36289 - DNA, 20 bp, Artificial Sequence
  Description of Artificial Sequence: Synthetic oligonucleotide
  Target: FXN; (+) strand; PAM type: YTN; PAM sequence: CTA
gtgttatctgctgccgtggc

SEQ ID NO: 36290 - DNA, 20 bp, Artificial Sequence
  Description of Artificial Sequence: Synthetic oligonucleotide
  Target: FXN; (+) strand; PAM type: YTN; PAM sequence: TTA
tctgctgccgtggccaatca

SEQ ID NO: 36291 - DNA, 20 bp, Artificial Sequence
  Description of Artificial Sequence: Synthetic oligonucleotide
  Target: FXN; (+) strand; PAM type: YTN; PAM sequence: CTG
ctgccgtggccaatcatcca

SEQ ID NO: 36292 - DNA, 20 bp, Artificial Sequence
  Description of Artificial Sequence: Synthetic oligonucleotide
  Target: FXN; (+) strand; PAM type: YTN; PAM sequence: CTG
ccgtggccaatcatccatga

SEQ ID NO: 36293 - DNA, 20 bp, Artificial Sequence
  Description of Artificial Sequence: Synthetic oligonucleotide
  Target: FXN; (+) strand; PAM type: YTN; PAM sequence: CTG
gtataagaagacatggcaga

SEQ ID NO: 36294 - DNA, 20 bp, Artificial Sequence
  Description of Artificial Sequence: Synthetic oligonucleotide
  Target: FXN; (+) strand; PAM type: YTN; PAM sequence: CTC
cgatctgtccacacgaatac

SEQ ID NO: 36295 - DNA, 20 bp, Artificial Sequence
  Description of Artificial Sequence: Synthetic oligonucleotide
  Target: FXN; (+) strand; PAM type: YTN; PAM sequence: CTG
tccacacgaatacagcattc

SEQ ID NO: 36296 - DNA, 20 bp, Artificial Sequence
  Description of Artificial Sequence: Synthetic oligonucleotide
  Target: FXN; (+) strand; PAM type: YTN; PAM sequence: TTC
ccaaagcaacgtgcatgtgc

SEQ ID NO: 36297 - DNA, 20 bp, Artificial Sequence
  Description of Artificial Sequence: Synthetic oligonucleotide
  Target: FXN; (+) strand; PAM type: YTN; PAM sequence: TTA
ttcactggatgagcttgagg

SEQ ID NO: 36298 - DNA, 20 bp, Artificial Sequence
  Description of Artificial Sequence: Synthetic oligonucleotide
  Target: FXN; (+) strand; PAM type: YTN; PAM sequence: TTC
actggatgagcttgaggtgg

SEQ ID NO: 36299 - DNA, 20 bp, Artificial Sequence
  Description of Artificial Sequence: Synthetic oligonucleotide
  Target: FXN; (+) strand; PAM type: YTN; PAM sequence: CTG
gatgagcttgaggtggatga

SEQ ID NO: 36300 - DNA, 20 bp, Artificial Sequence
  Description of Artificial Sequence: Synthetic oligonucleotide
  Target: FXN; (+) strand; PAM type: YTN; PAM sequence: CTT
gaggtggatgaactagccca

SEQ ID NO: 36301 - DNA, 20 bp, Artificial Sequence
  Description of Artificial Sequence: Synthetic oligonucleotide
  Target: FXN; (+) strand; PAM type: YTN; PAM sequence: TTG
aggtggatgaactagcccac

SEQ ID NO: 36302 - DNA, 20 bp, Artificial Sequence
  Description of Artificial Sequence: Synthetic oligonucleotide
  Target: FXN; (+) strand; PAM type: YTN; PAM sequence: CTA
gcccaccaggctctcaatgt

SEQ ID NO: 36303 - DNA, 20 bp, Artificial Sequence
  Description of Artificial Sequence: Synthetic oligonucleotide
  Target: FXN; (+) strand; PAM type: YTN; PAM sequence: CTC
tcaatgtcatgaatttaaca

SEQ ID NO: 36304 - DNA, 20 bp, Artificial Sequence
  Description of Artificial Sequence: Synthetic oligonucleotide
  Target: FXN; (+) strand; PAM type: YTN; PAM sequence: CTC
aatgtcatgaatttaacact

SEQ ID NO: 36305 - DNA, 20 bp, Artificial Sequence
  Description of Artificial Sequence: Synthetic oligonucleotide
  Target: FXN; (+) strand; PAM type: YTN; PAM sequence: TTT
aacactgaattaagaaaaat

SEQ ID NO: 36306 - DNA, 20 bp, Artificial Sequence
  Description of Artificial Sequence: Synthetic oligonucleotide
  Target: FXN; (+) strand; PAM type: YTN; PAM sequence: TTA
acactgaattaagaaaaata

SEQ ID NO: 36307 - DNA, 20 bp, Artificial Sequence
  Description of Artificial Sequence: Synthetic oligonucleotide
  Target: FXN; (+) strand; PAM type: YTN; PAM sequence: CTG
aattaagaaaaatatgtttt

SEQ ID NO: 36308 - DNA, 20 bp, Artificial Sequence
  Description of Artificial Sequence: Synthetic oligonucleotide
  Target: FXN; (+) strand; PAM type: YTN; PAM sequence: TTA
agaaaaatatgttttaaaaa

SEQ ID NO: 36309 - DNA, 20 bp, Artificial Sequence
  Description of Artificial Sequence: Synthetic oligonucleotide
  Target: FXN; (+) strand; PAM type: YTN; PAM sequence: TTT
taaaaataatagtttaggtg

SEQ ID NO: 36310 - DNA, 20 bp, Artificial Sequence
  Description of Artificial Sequence: Synthetic oligonucleotide
  Target: FXN; (+) strand; PAM type: YTN; PAM sequence: TTT
aaaaataatagtttaggtga

SEQ ID NO: 36311 - DNA, 20 bp, Artificial Sequence
  Description of Artificial Sequence: Synthetic oligonucleotide
  Target: FXN; (+) strand; PAM type: YTN; PAM sequence: TTA
aaaataatagtttaggtgat

SEQ ID NO: 36312 - DNA, 20 bp, Artificial Sequence
  Description of Artificial Sequence: Synthetic oligonucleotide
  Target: FXN; (+) strand; PAM type: YTN; PAM sequence: TTT
aggtgattgctggggtgcta

SEQ ID NO: 36313 - DNA, 20 bp, Artificial Sequence
  Description of Artificial Sequence: Synthetic oligonucleotide
  Target: FXN; (+) strand; PAM type: YTN; PAM sequence: TTA
ggtgattgctggggtgctag

SEQ ID NO: 36314 - DNA, 20 bp, Artificial Sequence
  Description of Artificial Sequence: Synthetic oligonucleotide
  Target: FXN; (+) strand; PAM type: YTN; PAM sequence: TTG
ctggggtgctaggagaggaa

SEQ ID NO: 36315 - DNA, 20 bp, Artificial Sequence
  Description of Artificial Sequence: Synthetic oligonucleotide
  Target: FXN; (+) strand; PAM type: YTN; PAM sequence: CTG
gggtgctaggagaggaagga

SEQ ID NO: 36316 - DNA, 20 bp, Artificial Sequence
  Description of Artificial Sequence: Synthetic oligonucleotide
  Target: FXN; (+) strand; PAM type: YTN; PAM sequence: CTA
ggagaggaaggaatggggaa

SEQ ID NO: 36317 - DNA, 20 bp, Artificial Sequence
  Description of Artificial Sequence: Synthetic oligonucleotide
  Target: FXN; (+) strand; PAM type: YTN; PAM sequence: CTG
tttaatgggtatagttggcc

SEQ ID NO: 36318 - DNA, 20 bp, Artificial Sequence
  Description of Artificial Sequence: Synthetic oligonucleotide
  Target: FXN; (+) strand; PAM type: YTN; PAM sequence: TTT
aatgggtatagttggccttg

SEQ ID NO: 36319 - DNA, 20 bp, Artificial Sequence
  Description of Artificial Sequence: Synthetic oligonucleotide
  Target: FXN; (+) strand; PAM type: YTN; PAM sequence: TTA
atgggtatagttggccttgt

SEQ ID NO: 36320 - DNA, 20 bp, Artificial Sequence
  Description of Artificial Sequence: Synthetic oligonucleotide
  Target: FXN; (+) strand; PAM type: YTN; PAM sequence: TTG
gccttgtgtatctgtgggtt

SEQ ID NO: 36321 - DNA, 20 bp, Artificial Sequence
  Description of Artificial Sequence: Synthetic oligonucleotide
  Target: FXN; (+) strand; PAM type: YTN; PAM sequence: CTT
gtgtatctgtgggttccaca

SEQ ID NO: 36322 - DNA, 20 bp, Artificial Sequence
  Description of Artificial Sequence: Synthetic oligonucleotide
  Target: FXN; (+) strand; PAM type: YTN; PAM sequence: TTG
tgtatctgtgggttccacat

SEQ ID NO: 36323 - DNA, 20 bp, Artificial Sequence
  Description of Artificial Sequence: Synthetic oligonucleotide
  Target: FXN; (+) strand; PAM type: YTN; PAM sequence: CTG
tgggttccacatctgattca

SEQ ID NO: 36324 - DNA, 20 bp, Artificial Sequence
  Description of Artificial Sequence: Synthetic oligonucleotide
  Target: FXN; (+) strand; PAM type: YTN; PAM sequence: TTC
cacatctgattcaaccaacc

SEQ ID NO: 36325 - DNA, 20 bp, Artificial Sequence
  Description of Artificial Sequence: Synthetic oligonucleotide
  Target: FXN; (+) strand; PAM type: YTN; PAM sequence: CTG
attcaaccaaccgtggatca

SEQ ID NO: 36326 - DNA, 20 bp, Artificial Sequence
  Description of Artificial Sequence: Synthetic oligonucleotide
  Target: FXN; (+) strand; PAM type: YTN; PAM sequence: TTC
aaccaaccgtggatcaaaat

SEQ ID NO: 36327 - DNA, 20 bp, Artificial Sequence
  Description of Artificial Sequence: Synthetic oligonucleotide
  Target: FXN; (+) strand; PAM type: YTN; PAM sequence: TTT
gaaaataaaaaacaaaacaa

SEQ ID NO: 36328 - DNA, 20 bp, Artificial Sequence
  Description of Artificial Sequence: Synthetic oligonucleotide
  Target: FXN; (+) strand; PAM type: YTN; PAM sequence: TTG
aaaataaaaaacaaaacaaa

SEQ ID NO: 36329 - DNA, 20 bp, Artificial Sequence
  Description of Artificial Sequence: Synthetic oligonucleotide
  Target: FXN; (+) strand; PAM type: YTN; PAM sequence: CTA
ttaacagcatttacattgta

SEQ ID NO: 36330 - DNA, 20 bp, Artificial Sequence
  Description of Artificial Sequence: Synthetic oligonucleotide
  Target: FXN; (+) strand; PAM type: YTN; PAM sequence: TTA
acagcatttacattgtacta

SEQ ID NO: 36331 - DNA, 20 bp, Artificial Sequence
  Description of Artificial Sequence: Synthetic oligonucleotide
  Target: FXN; (+) strand; PAM type: YTN; PAM sequence: TTT
acattgtactaggcattata

SEQ ID NO: 36332 - DNA, 20 bp, Artificial Sequence
  Description of Artificial Sequence: Synthetic oligonucleotide
  Target: FXN; (+) strand; PAM type: YTN; PAM sequence: TTA
cattgtactaggcattataa

SEQ ID NO: 36333 - DNA, 20 bp, Artificial Sequence
  Description of Artificial Sequence: Synthetic oligonucleotide
  Target: FXN; (+) strand; PAM type: YTN; PAM sequence: TTG
tactaggcattataagtaat

SEQ ID NO: 36334 - DNA, 20 bp, Artificial Sequence
  Description of Artificial Sequence: Synthetic oligonucleotide
  Target: FXN; (+) strand; PAM type: YTN; PAM sequence: CTA
ggcattataagtaatctgga

SEQ ID NO: 36335 - DNA, 20 bp, Artificial Sequence
  Description of Artificial Sequence: Synthetic oligonucleotide
  Target: FXN; (+) strand; PAM type: YTN; PAM sequence: TTA
taagtaatctggagatgact

SEQ ID NO: 36336 - DNA, 20 bp, Artificial Sequence
  Description of Artificial Sequence: Synthetic oligonucleotide
  Target: FXN; (+) strand; PAM type: YTN; PAM sequence: CTG
gagatgacttaaagcataca

SEQ ID NO: 36337 - DNA, 20 bp, Artificial Sequence
  Description of Artificial Sequence: Synthetic oligonucleotide
  Target: FXN; (+) strand; PAM type: YTN; PAM sequence: CTT
aaagcatacagaaggatgtg

SEQ ID NO: 36338 - DNA, 20 bp, Artificial Sequence
  Description of Artificial Sequence: Synthetic oligonucleotide
  Target: FXN; (+) strand; PAM type: YTN; PAM sequence: TTA
aagcatacagaaggatgtgc

SEQ ID NO: 36339 - DNA, 20 bp, Artificial Sequence
  Description of Artificial Sequence: Synthetic oligonucleotide
  Target: FXN; (+) strand; PAM type: YTN; PAM sequence: CTA
ggttagatgcatgtatcgta

SEQ ID NO: 36340 - DNA, 20 bp, Artificial Sequence
  Description of Artificial Sequence: Synthetic oligonucleotide
  Target: FXN; (+) strand; PAM type: YTN; PAM sequence: TTA
gatgcatgtatcgtaccatt

SEQ ID NO: 36341 - DNA, 20 bp, Artificial Sequence
  Description of Artificial Sequence: Synthetic oligonucleotide
  Target: FXN; (+) strand; PAM type: YTN; PAM sequence: TTT
catatcagggacttgagtac

SEQ ID NO: 36342 - DNA, 20 bp, Artificial Sequence
  Description of Artificial Sequence: Synthetic oligonucleotide
  Target: FXN; (+) strand; PAM type: YTN; PAM sequence: TTC
atatcagggacttgagtacc

SEQ ID NO: 36343 - DNA, 20 bp, Artificial Sequence
  Description of Artificial Sequence: Synthetic oligonucleotide
  Target: FXN; (+) strand; PAM type: YTN; PAM sequence: CTT
gagtacccacggattttggt

SEQ ID NO: 36344 - DNA, 20 bp, Artificial Sequence
  Description of Artificial Sequence: Synthetic oligonucleotide
  Target: FXN; (+) strand; PAM type: YTN; PAM sequence: TTG
agtacccacggattttggta

SEQ ID NO: 36345 - DNA, 20 bp, Artificial Sequence
  Description of Artificial Sequence: Synthetic oligonucleotide
  Target: FXN; (+) strand; PAM type: YTN; PAM sequence: TTT
tggtatctgcagatcctgga

SEQ ID NO: 36346 - DNA, 20 bp, Artificial Sequence
  Description of Artificial Sequence: Synthetic oligonucleotide
  Target: FXN; (+) strand; PAM type: YTN; PAM sequence: TTT
ggtatctgcagatcctggaa

SEQ ID NO: 36347 - DNA, 20 bp, Artificial Sequence
  Description of Artificial Sequence: Synthetic oligonucleotide
  Target: FXN; (+) strand; PAM type: YTN; PAM sequence: TTG
gtatctgcagatcctggaac

SEQ ID NO: 36348 - DNA, 20 bp, Artificial Sequence
  Description of Artificial Sequence: Synthetic oligonucleotide
  Target: FXN; (+) strand; PAM type: YTN; PAM sequence: CTG
cagatcctggaaccccttcc

SEQ ID NO: 36349 - DNA, 20 bp, Artificial Sequence
  Description of Artificial Sequence: Synthetic oligonucleotide
  Target: FXN; (+) strand; PAM type: YTN; PAM sequence: CTG
gaaccccttccctatggata

SEQ ID NO: 36350 - DNA, 20 bp, Artificial Sequence
  Description of Artificial Sequence: Synthetic oligonucleotide
  Target: FXN; (+) strand; PAM type: YTN; PAM sequence: CTT
ccctatggataccaaggaac

SEQ ID NO: 36351 - DNA, 20 bp, Artificial Sequence
  Description of Artificial Sequence: Synthetic oligonucleotide
  Target: FXN; (+) strand; PAM type: YTN; PAM sequence: TTC
cctatggataccaaggaaca

SEQ ID NO: 36352 - DNA, 20 bp, Artificial Sequence
  Description of Artificial Sequence: Synthetic oligonucleotide
  Target: FXN; (+) strand; PAM type: YTN; PAM sequence: CTA
tggataccaaggaacaacag

SEQ ID NO: 36353 - DNA, 20 bp, Artificial Sequence
  Description of Artificial Sequence: Synthetic oligonucleotide
  Target: FXN; (+) strand; PAM type: YTN; PAM sequence: CTG
ggtctccttttggggtgatg

SEQ ID NO: 36354 - DNA, 20 bp, Artificial Sequence
  Description of Artificial Sequence: Synthetic oligonucleotide
  Target: FXN; (+) strand; PAM type: YTN; PAM sequence: CTC
cttttggggtgatgcagatg

SEQ ID NO: 36355 - DNA, 20 bp, Artificial Sequence
  Description of Artificial Sequence: Synthetic oligonucleotide
  Target: FXN; (+) strand; PAM type: YTN; PAM sequence: CTT
ttggggtgatgcagatgttt

SEQ ID NO: 36356 - DNA, 20 bp, Artificial Sequence
  Description of Artificial Sequence: Synthetic oligonucleotide
  Target: FXN; (+) strand; PAM type: YTN; PAM sequence: TTT
tggggtgatgcagatgtttt

SEQ ID NO: 36357 - DNA, 20 bp, Artificial Sequence
  Description of Artificial Sequence: Synthetic oligonucleotide
  Target: FXN; (+) strand; PAM type: YTN; PAM sequence: TTT
ggggtgatgcagatgttttg

SEQ ID NO: 36358 - DNA, 20 bp, Artificial Sequence
  Description of Artificial Sequence: Synthetic oligonucleotide
  Target: FXN; (+) strand; PAM type: YTN; PAM sequence: TTG
gggtgatgcagatgttttga

SEQ ID NO: 36359 - DNA, 20 bp, Artificial Sequence
  Description of Artificial Sequence: Synthetic oligonucleotide
  Target: FXN; (+) strand; PAM type: YTN; PAM sequence: TTT
tgaagctaggcagaggtagt

SEQ ID NO: 36360 - DNA, 20 bp, Artificial Sequence
  Description of Artificial Sequence: Synthetic oligonucleotide
  Target: FXN; (+) strand; PAM type: YTN; PAM sequence: TTT
gaagctaggcagaggtagtg

SEQ ID NO: 36361 - DNA, 20 bp, Artificial Sequence
  Description of Artificial Sequence: Synthetic oligonucleotide
  Target: FXN; (+) strand; PAM type: YTN; PAM sequence: TTG
aagctaggcagaggtagtgg

SEQ ID NO: 36362 - DNA, 20 bp, Artificial Sequence
  Description of Artificial Sequence: Synthetic oligonucleotide
  Target: FXN; (+) strand; PAM type: YTN; PAM sequence: CTA
ggcagaggtagtggttgcac

SEQ ID NO: 36363 - DNA, 20 bp, Artificial Sequence
  Description of Artificial Sequence: Synthetic oligonucleotide
  Target: FXN; (+) strand; PAM type: YTN; PAM sequence: TTG
cacaacattgtaaatgtact

SEQ ID NO: 36364 - DNA, 20 bp, Artificial Sequence
  Description of Artificial Sequence: Synthetic oligonucleotide
  Target: FXN; (+) strand; PAM type: YTN; PAM sequence: TTG
taaatgtactaaatgccacc

SEQ ID NO: 36365 - DNA, 20 bp, Artificial Sequence
  Description of Artificial Sequence: Synthetic oligonucleotide
  Target: FXN; (+) strand; PAM type: YTN; PAM sequence: CTA
aatgccaccaaattattcat

SEQ ID NO: 36366 - DNA, 20 bp, Artificial Sequence
  Description of Artificial Sequence: Synthetic oligonucleotide
  Target: FXN; (+) strand; PAM type: YTN; PAM sequence: TTA
ttcatttttaaatggttaat

SEQ ID NO: 36367 - DNA, 20 bp, Artificial Sequence
  Description of Artificial Sequence: Synthetic oligonucleotide
  Target: FXN; (+) strand; PAM type: YTN; PAM sequence: TTC
atttttaaatggttaatgtg

SEQ ID NO: 36368 - DNA, 20 bp, Artificial Sequence
  Description of Artificial Sequence: Synthetic oligonucleotide
  Target: FXN; (+) strand; PAM type: YTN; PAM sequence: TTT
ttaaatggttaatgtgttat

SEQ ID NO: 36369 - DNA, 20 bp, Artificial Sequence
  Description of Artificial Sequence: Synthetic oligonucleotide
  Target: FXN; (+) strand; PAM type: YTN; PAM sequence: TTT
taaatggttaatgtgttatg

SEQ ID NO: 36370 - DNA, 20 bp, Artificial Sequence
  Description of Artificial Sequence: Synthetic oligonucleotide
  Target: FXN; (+) strand; PAM type: YTN; PAM sequence: TTT
aaatggttaatgtgttatgt

SEQ ID NO: 36371 - DNA, 20 bp, Artificial Sequence
  Description of Artificial Sequence: Synthetic oligonucleotide
  Target: FXN; (+) strand; PAM type: YTN; PAM sequence: TTA
aatggttaatgtgttatgtg

SEQ ID NO: 36372 - DNA, 20 bp, Artificial Sequence
  Description of Artificial Sequence: Synthetic oligonucleotide
  Target: FXN; (+) strand; PAM type: YTN; PAM sequence: TTA
atgtgttatgtgaatttcac

SEQ ID NO: 36373 - DNA, 20 bp, Artificial Sequence
  Description of Artificial Sequence: Synthetic oligonucleotide
  Target: FXN; (+) strand; PAM type: YTN; PAM sequence: TTA
tgtgaatttcaccttaacaa

SEQ ID NO: 36374 - DNA, 20 bp, Artificial Sequence
  Description of Artificial Sequence: Synthetic oligonucleotide
  Target: FXN; (+) strand; PAM type: YTN; PAM sequence: TTT
caccttaacaactaataata

SEQ ID NO: 36375 - DNA, 20 bp, Artificial Sequence
  Description of Artificial Sequence: Synthetic oligonucleotide
  Target: FXN; (+) strand; PAM type: YTN; PAM sequence: TTC
accttaacaactaataatat

SEQ ID NO: 36376 - DNA, 20 bp, Artificial Sequence
  Description of Artificial Sequence: Synthetic oligonucleotide
  Target: FXN; (+) strand; PAM type: YTN; PAM sequence: CTT
aacaactaataatattatag

SEQ ID NO: 36377 - DNA, 20 bp, Artificial Sequence
  Description of Artificial Sequence: Synthetic oligonucleotide
  Target: FXN; (+) strand; PAM type: YTN; PAM sequence: TTA
acaactaataatattatagg

SEQ ID NO: 36378 - DNA, 20 bp, Artificial Sequence
  Description of Artificial Sequence: Synthetic oligonucleotide
  Target: FXN; (+) strand; PAM type: YTN; PAM sequence: CTA
ataatattataggtaaggca

SEQ ID NO: 36379 - DNA, 20 bp, Artificial Sequence
  Description of Artificial Sequence: Synthetic oligonucleotide
  Target: FXN; (+) strand; PAM type: YTN; PAM sequence: TTA
taggtaaggcacaagttaca

SEQ ID NO: 36380 - DNA, 20 bp, Artificial Sequence
  Description of Artificial Sequence: Synthetic oligonucleotide
  Target: FXN; (+) strand; PAM type: YTN; PAM sequence: TTA
catctgtagcacaaaaatgg

SEQ ID NO: 36381 - DNA, 20 bp, Artificial Sequence
  Description of Artificial Sequence: Synthetic oligonucleotide
  Target: FXN; (+) strand; PAM type: YTN; PAM sequence: CTG
tagcacaaaaatggccctaa

SEQ ID NO: 36382 - DNA, 20 bp, Artificial Sequence
  Description of Artificial Sequence: Synthetic oligonucleotide
  Target: FXN; (+) strand; PAM type: YTN; PAM sequence: CTA
atttttaaaacactgctcca

SEQ ID NO: 36383 - DNA, 20 bp, Artificial Sequence
  Description of Artificial Sequence: Synthetic oligonucleotide
  Target: FXN; (+) strand; PAM type: YTN; PAM sequence: TTT
ttaaaacactgctccagcat

SEQ ID NO: 36384 - DNA, 20 bp, Artificial Sequence
  Description of Artificial Sequence: Synthetic oligonucleotide
  Target: FXN; (+) strand; PAM type: YTN; PAM sequence: TTT
taaaacactgctccagcata

SEQ ID NO: 36385 - DNA, 20 bp, Artificial Sequence
  Description of Artificial Sequence: Synthetic oligonucleotide
  Target: FXN; (+) strand; PAM type: YTN; PAM sequence: TTT
aaaacactgctccagcatag

SEQ ID NO: 36386 - DNA, 20 bp, Artificial Sequence
  Description of Artificial Sequence: Synthetic oligonucleotide
  Target: FXN; (+) strand; PAM type: YTN; PAM sequence: TTA
aaacactgctccagcatagc

SEQ ID NO: 36387 - DNA, 20 bp, Artificial Sequence
  Description of Artificial Sequence: Synthetic oligonucleotide
  Target: FXN; (+) strand; PAM type: YTN; PAM sequence: CTG
ctccagcatagcaggtatca

SEQ ID NO: 36388 - DNA, 20 bp, Artificial Sequence
  Description of Artificial Sequence: Synthetic oligonucleotide
  Target: FXN; (+) strand; PAM type: YTN; PAM sequence: CTC
cagcatagcaggtatcacat

SEQ ID NO: 36389 - DNA, 20 bp, Artificial Sequence
  Description of Artificial Sequence: Synthetic oligonucleotide
  Target: FXN; (+) strand; PAM type: YTN; PAM sequence: CTG
gagatcaaagtgtgatacct

SEQ ID NO: 36390 - DNA, 20 bp, Artificial Sequence
  Description of Artificial Sequence: Synthetic oligonucleotide
  Target: FXN; (+) strand; PAM type: YTN; PAM sequence: CTG
gagacttatcagtaagggtc

SEQ ID NO: 36391 - DNA, 20 bp, Artificial Sequence
  Description of Artificial Sequence: Synthetic oligonucleotide
  Target: FXN; (+) strand; PAM type: YTN; PAM sequence: CTT
atcagtaagggtcaaatgtt

SEQ ID NO: 36392 - DNA, 20 bp, Artificial Sequence
  Description of Artificial Sequence: Synthetic oligonucleotide
  Target: FXN; (+) strand; PAM type: YTN; PAM sequence: TTA
tcagtaagggtcaaatgttt

SEQ ID NO: 36393 - DNA, 20 bp, Artificial Sequence
  Description of Artificial Sequence: Synthetic oligonucleotide
  Target: FXN; (+) strand; PAM type: YTN; PAM sequence: TTT
tttcaggttttgagaatcat

SEQ ID NO: 36394 - DNA, 20 bp, Artificial Sequence
  Description of Artificial Sequence: Synthetic oligonucleotide
  Target: FXN; (+) strand; PAM type: YTN; PAM sequence: TTT
ttcaggttttgagaatcatt

SEQ ID NO: 36395 - DNA, 20 bp, Artificial Sequence
  Description of Artificial Sequence: Synthetic oligonucleotide
  Target: FXN; (+) strand; PAM type: YTN; PAM sequence: TTT
tcaggttttgagaatcattc

SEQ ID NO: 36396 - DNA, 20 bp, Artificial Sequence
  Description of Artificial Sequence: Synthetic oligonucleotide
  Target: FXN; (+) strand; PAM type: YTN; PAM sequence: TTT
caggttttgagaatcattct

SEQ ID NO: 36397 - DNA, 20 bp, Artificial Sequence
  Description of Artificial Sequence: Synthetic oligonucleotide
  Target: FXN; (+) strand; PAM type: YTN; PAM sequence: TTC
aggttttgagaatcattctt

SEQ ID NO: 36398 - DNA, 20 bp, Artificial Sequence
  Description of Artificial Sequence: Synthetic oligonucleotide
  Target: FXN; (+) strand; PAM type: YTN; PAM sequence: TTT
tgagaatcattcttggaatt

SEQ ID NO: 36399 - DNA, 20 bp, Artificial Sequence
  Description of Artificial Sequence: Synthetic oligonucleotide
  Target: FXN; (+) strand; PAM type: YTN; PAM sequence: TTT
gagaatcattcttggaattg

SEQ ID NO: 36400 - DNA, 20 bp, Artificial Sequence
  Description of Artificial Sequence: Synthetic oligonucleotide
  Target: FXN; (+) strand; PAM type: YTN; PAM sequence: TTG
agaatcattcttggaattgt

SEQ ID NO: 36401 - DNA, 20 bp, Artificial Sequence
  Description of Artificial Sequence: Synthetic oligonucleotide
  Target: FXN; (+) strand; PAM type: YTN; PAM sequence: TTC
ttggaattgttccagaagat

SEQ ID NO: 36402 - DNA, 20 bp, Artificial Sequence
  Description of Artificial Sequence: Synthetic oligonucleotide
  Target: FXN; (+) strand; PAM type: YTN; PAM sequence: CTT
ggaattgttccagaagatat

SEQ ID NO: 36403 - DNA, 20 bp, Artificial Sequence
  Description of Artificial Sequence: Synthetic oligonucleotide
  Target: FXN; (+) strand; PAM type: YTN; PAM sequence: TTG
gaattgttccagaagatata

SEQ ID NO: 36404 - DNA, 20 bp, Artificial Sequence
  Description of Artificial Sequence: Synthetic oligonucleotide
  Target: FXN; (+) strand; PAM type: YTN; PAM sequence: TTG
ttccagaagatatatcgtat

SEQ ID NO: 36405 - DNA, 20 bp, Artificial Sequence
  Description of Artificial Sequence: Synthetic oligonucleotide
  Target: FXN; (+) strand; PAM type: YTN; PAM sequence: TTC
cagaagatatatcgtataac

SEQ ID NO: 36406 - DNA, 20 bp, Artificial Sequence
  Description of Artificial Sequence: Synthetic oligonucleotide
  Target: FXN; (+) strand; PAM type: YTN; PAM sequence: CTC
ttcttagatgctaagataag

SEQ ID NO: 36407 - DNA, 20 bp, Artificial Sequence
  Description of Artificial Sequence: Synthetic oligonucleotide
  Target: FXN; (+) strand; PAM type: YTN; PAM sequence: CTT
cttagatgctaagataagaa

SEQ ID NO: 36408 - DNA, 20 bp, Artificial Sequence
  Description of Artificial Sequence: Synthetic oligonucleotide
  Target: FXN; (+) strand; PAM type: YTN; PAM sequence: TTC
ttagatgctaagataagaag

SEQ ID NO: 36409 - DNA, 20 bp, Artificial Sequence
  Description of Artificial Sequence: Synthetic oligonucleotide
  Target: FXN; (+) strand; PAM type: YTN; PAM sequence: CTT
agatgctaagataagaaggc

SEQ ID NO: 36410 - DNA, 20 bp, Artificial Sequence
  Description of Artificial Sequence: Synthetic oligonucleotide
  Target: FXN; (+) strand; PAM type: YTN; PAM sequence: TTA
gatgctaagataagaaggca

SEQ ID NO: 36411 - DNA, 20 bp, Artificial Sequence
  Description of Artificial Sequence: Synthetic oligonucleotide
  Target: FXN; (+) strand; PAM type: YTN; PAM sequence: CTA
agataagaaggcagatatac

SEQ ID NO: 36412 - DNA, 20 bp, Artificial Sequence
  Description of Artificial Sequence: Synthetic oligonucleotide
  Target: FXN; (+) strand; PAM type: YTN; PAM sequence: CTA
gctcattttgtgttattttc

SEQ ID NO: 36413 - DNA, 20 bp, Artificial Sequence
  Description of Artificial Sequence: Synthetic oligonucleotide
  Target: FXN; (+) strand; PAM type: YTN; PAM sequence: CTC
attttgtgttattttctaga

SEQ ID NO: 36414 - DNA, 20 bp, Artificial Sequence
  Description of Artificial Sequence: Synthetic oligonucleotide
  Target: FXN; (+) strand; PAM type: YTN; PAM sequence: TTT
tgtgttattttctagagctt

SEQ ID NO: 36415 - DNA, 20 bp, Artificial Sequence
  Description of Artificial Sequence: Synthetic oligonucleotide
  Target: FXN; (+) strand; PAM type: YTN; PAM sequence: TTT
gtgttattttctagagcttt

SEQ ID NO: 36416 - DNA, 20 bp, Artificial Sequence
  Description of Artificial Sequence: Synthetic oligonucleotide
  Target: FXN; (+) strand; PAM type: YTN; PAM sequence: TTG
tgttattttctagagcttta

SEQ ID NO: 36417 - DNA, 20 bp, Artificial Sequence
  Description of Artificial Sequence: Synthetic oligonucleotide
  Target: FXN; (+) strand; PAM type: YTN; PAM sequence: TTA
ttttctagagctttactcca

SEQ ID NO: 36418 - DNA, 20 bp, Artificial Sequence
  Description of Artificial Sequence: Synthetic oligonucleotide
  Target: FXN; (+) strand; PAM type: YTN; PAM sequence: TTT
tctagagctttactccagtc

SEQ ID NO: 36419 - DNA, 20 bp, Artificial Sequence
  Description of Artificial Sequence: Synthetic oligonucleotide
  Target: FXN; (+) strand; PAM type: YTN; PAM sequence: TTT
ctagagctttactccagtca

SEQ ID NO: 36420 - DNA, 20 bp, Artificial Sequence
  Description of Artificial Sequence: Synthetic oligonucleotide
  Target: FXN; (+) strand; PAM type: YTN; PAM sequence: TTC
tagagctttactccagtcaa

SEQ ID NO: 36421 - DNA, 20 bp, Artificial Sequence
  Description of Artificial Sequence: Synthetic oligonucleotide
  Target: FXN; (+) strand; PAM type: YTN; PAM sequence: CTA
gagctttactccagtcaatt

SEQ ID NO: 36422 - DNA, 20 bp, Artificial Sequence
  Description of Artificial Sequence: Synthetic oligonucleotide
  Target: FXN; (+) strand; PAM type: YTN; PAM sequence: CTT
tactccagtcaatttcttgg

SEQ ID NO: 36423 - DNA, 20 bp, Artificial Sequence
  Description of Artificial Sequence: Synthetic oligonucleotide
  Target: FXN; (+) strand; PAM type: YTN; PAM sequence: TTT
actccagtcaatttcttggg

SEQ ID NO: 36424 - DNA, 20 bp, Artificial Sequence
  Description of Artificial Sequence: Synthetic oligonucleotide
  Target: FXN; (+) strand; PAM type: YTN; PAM sequence: TTA
ctccagtcaatttcttgggg

SEQ ID NO: 36425 - DNA, 20 bp, Artificial Sequence
  Description of Artificial Sequence: Synthetic oligonucleotide
  Target: FXN; (+) strand; PAM type: YTN; PAM sequence: CTC
cagtcaatttcttgggggca

SEQ ID NO: 36426 - DNA, 20 bp, Artificial Sequence
  Description of Artificial Sequence: Synthetic oligonucleotide
  Target: FXN; (+) strand; PAM type: YTN; PAM sequence: TTT
cttgggggcagcatttgtgg

SEQ ID NO: 36427 - DNA, 20 bp, Artificial Sequence
  Description of Artificial Sequence: Synthetic oligonucleotide
  Target: FXN; (+) strand; PAM type: YTN; PAM sequence: TTC
ttgggggcagcatttgtgga

SEQ ID NO: 36428 - DNA, 20 bp, Artificial Sequence
  Description of Artificial Sequence: Synthetic oligonucleotide
  Target: FXN; (+) strand; PAM type: YTN; PAM sequence: CTT
gggggcagcatttgtggaat

SEQ ID NO: 36429 - DNA, 20 bp, Artificial Sequence
  Description of Artificial Sequence: Synthetic oligonucleotide
  Target: FXN; (+) strand; PAM type: YTN; PAM sequence: TTG
ggggcagcatttgtggaatc

SEQ ID NO: 36430 - DNA, 20 bp, Artificial Sequence
  Description of Artificial Sequence: Synthetic oligonucleotide
  Target: FXN; (+) strand; PAM type: YTN; PAM sequence: TTT
gtggaatcagtggttcatct

SEQ ID NO: 36431 - DNA, 20 bp, Artificial Sequence
  Description of Artificial Sequence: Synthetic oligonucleotide
  Target: FXN; (+) strand; PAM type: YTN; PAM sequence: TTG
tggaatcagtggttcatctg

SEQ ID NO: 36432 - DNA, 20 bp, Artificial Sequence
  Description of Artificial Sequence: Synthetic oligonucleotide
  Target: FXN; (+) strand; PAM type: YTN; PAM sequence: TTC
atctgaagggctgtgctgtg

SEQ ID NO: 36433 - DNA, 20 bp, Artificial Sequence
  Description of Artificial Sequence: Synthetic oligonucleotide
  Target: FXN; (+) strand; PAM type: YTN; PAM sequence: CTG
aagggctgtgctgtggaatt

SEQ ID NO: 36434 - DNA, 20 bp, Artificial Sequence
  Description of Artificial Sequence: Synthetic oligonucleotide
  Target: FXN; (+) strand; PAM type: YTN; PAM sequence: CTG
tgctgtggaattactatgca

SEQ ID NO: 36435 - DNA, 20 bp, Artificial Sequence
  Description of Artificial Sequence: Synthetic oligonucleotide
  Target: FXN; (+) strand; PAM type: YTN; PAM sequence: CTG
tggaattactatgcatttgt

SEQ ID NO: 36436 - DNA, 20 bp, Artificial Sequence
  Description of Artificial Sequence: Synthetic oligonucleotide
  Target: FXN; (+) strand; PAM type: YTN; PAM sequence: TTA
ctatgcatttgttttgtctt

SEQ ID NO: 36437 - DNA, 20 bp, Artificial Sequence
  Description of Artificial Sequence: Synthetic oligonucleotide
  Target: FXN; (+) strand; PAM type: YTN; PAM sequence: CTA
tgcatttgttttgtcttcca

SEQ ID NO: 36438 - DNA, 20 bp, Artificial Sequence
  Description of Artificial Sequence: Synthetic oligonucleotide
  Target: FXN; (+) strand; PAM type: YTN; PAM sequence: TTT
gttttgtcttccagtggacc

SEQ ID NO: 36439 - DNA, 20 bp, Artificial Sequence
  Description of Artificial Sequence: Synthetic oligonucleotide
  Target: FXN; (+) strand; PAM type: YTN; PAM sequence: TTG
ttttgtcttccagtggacct

SEQ ID NO: 36440 - DNA, 20 bp, Artificial Sequence
  Description of Artificial Sequence: Synthetic oligonucleotide
  Target: FXN; (+) strand; PAM type: YTN; PAM sequence: TTT
tgtcttccagtggacctaag

SEQ ID NO: 36441 - DNA, 20 bp, Artificial Sequence
  Description of Artificial Sequence: Synthetic oligonucleotide
  Target: FXN; (+) strand; PAM type: YTN; PAM sequence: TTT
gtcttccagtggacctaagc

SEQ ID NO: 36442 - DNA, 20 bp, Artificial Sequence
  Description of Artificial Sequence: Synthetic oligonucleotide
  Target: FXN; (+) strand; PAM type: YTN; PAM sequence: TTG
tcttccagtggacctaagcg

SEQ ID NO: 36443 - DNA, 20 bp, Artificial Sequence
  Description of Artificial Sequence: Synthetic oligonucleotide
  Target: FXN; (+) strand; PAM type: YTN; PAM sequence: CTT
ccagtggacctaagcgttat

SEQ ID NO: 36444 - DNA, 20 bp, Artificial Sequence
  Description of Artificial Sequence: Synthetic oligonucleotide
  Target: FXN; (+) strand; PAM type: YTN; PAM sequence: TTC
cagtggacctaagcgttatg

SEQ ID NO: 36445 - DNA, 20 bp, Artificial Sequence
  Description of Artificial Sequence: Synthetic oligonucleotide
  Target: FXN; (+) strand; PAM type: YTN; PAM sequence: CTA
agcgttatgactggactggg

SEQ ID NO: 36446 - DNA, 20 bp, Artificial Sequence
  Description of Artificial Sequence: Synthetic oligonucleotide
  Target: FXN; (+) strand; PAM type: YTN; PAM sequence: TTA
tgactggactgggaaaaact

SEQ ID NO: 36447 - DNA, 20 bp, Artificial Sequence
  Description of Artificial Sequence: Synthetic oligonucleotide
  Target: FXN; (+) strand; PAM type: YTN; PAM sequence: CTG
gactgggaaaaactgggtgt

SEQ ID NO: 36448 - DNA, 20 bp, Artificial Sequence
  Description of Artificial Sequence: Synthetic oligonucleotide
  Target: FXN; (+) strand; PAM type: YTN; PAM sequence: CTG
ggaaaaactgggtgtactcc

SEQ ID NO: 36449 - DNA, 20 bp, Artificial Sequence
  Description of Artificial Sequence: Synthetic oligonucleotide
  Target: FXN; (+) strand; PAM type: YTN; PAM sequence: CTG
ggtgtactcccacgacggcg

SEQ ID NO: 36450 - DNA, 20 bp, Artificial Sequence
  Description of Artificial Sequence: Synthetic oligonucleotide
  Target: FXN; (+) strand; PAM type: YTN; PAM sequence: CTC
ccacgacggcgtgtccctcc

SEQ ID NO: 36451 - DNA, 20 bp, Artificial Sequence
  Description of Artificial Sequence: Synthetic oligonucleotide
  Target: FXN; (+) strand; PAM type: YTN; PAM sequence: CTC
catgagctgctggccgcaga

SEQ ID NO: 36452 - DNA, 20 bp, Artificial Sequence
  Description of Artificial Sequence: Synthetic oligonucleotide
  Target: FXN; (+) strand; PAM type: YTN; PAM sequence: CTG
ctggccgcagagctcactaa

SEQ ID NO: 36453 - DNA, 20 bp, Artificial Sequence
  Description of Artificial Sequence: Synthetic oligonucleotide
  Target: FXN; (+) strand; PAM type: YTN; PAM sequence: CTG
gccgcagagctcactaaagc

SEQ ID NO: 36454 - DNA, 20 bp, Artificial Sequence
  Description of Artificial Sequence: Synthetic oligonucleotide
  Target: FXN; (+) strand; PAM type: YTN; PAM sequence: CTC
actaaagccttaaaaaccaa

SEQ ID NO: 36455 - DNA, 20 bp, Artificial Sequence
  Description of Artificial Sequence: Synthetic oligonucleotide
  Target: FXN; (+) strand; PAM type: YTN; PAM sequence: CTA
aagccttaaaaaccaaactg

SEQ ID NO: 36456 - DNA, 20 bp, Artificial Sequence
  Description of Artificial Sequence: Synthetic oligonucleotide
  Target: FXN; (+) strand; PAM type: YTN; PAM sequence: CTT
aaaaaccaaactggacttgt

SEQ ID NO: 36457 - DNA, 20 bp, Artificial Sequence
  Description of Artificial Sequence: Synthetic oligonucleotide
  Target: FXN; (+) strand; PAM type: YTN; PAM sequence: TTA
aaaaccaaactggacttgtc

SEQ ID NO: 36458 - DNA, 20 bp, Artificial Sequence
  Description of Artificial Sequence: Synthetic oligonucleotide
  Target: FXN; (+) strand; PAM type: YTN; PAM sequence: CTG
gacttgtcttccttggccta

SEQ ID NO: 36459 - DNA, 20 bp, Artificial Sequence
  Description of Artificial Sequence: Synthetic oligonucleotide
  Target: FXN; (+) strand; PAM type: YTN; PAM sequence: CTT
gtcttccttggcctattccg

SEQ ID NO: 36460 - DNA, 20 bp, Artificial Sequence
  Description of Artificial Sequence: Synthetic oligonucleotide
  Target: FXN; (+) strand; PAM type: YTN; PAM sequence: TTG
tcttccttggcctattccgg

SEQ ID NO: 36461 - DNA, 20 bp, Artificial Sequence
  Description of Artificial Sequence: Synthetic oligonucleotide
  Target: FXN; (+) strand; PAM type: YTN; PAM sequence: CTT
ccttggcctattccggaaaa

SEQ ID NO: 36462 - DNA, 20 bp, Artificial Sequence
  Description of Artificial Sequence: Synthetic oligonucleotide
  Target: FXN; (+) strand; PAM type: YTN; PAM sequence: TTC
cttggcctattccggaaaag

SEQ ID NO: 36463 - DNA, 20 bp, Artificial Sequence
  Description of Artificial Sequence: Synthetic oligonucleotide
  Target: FXN; (+) strand; PAM type: YTN; PAM sequence: CTT
ggcctattccggaaaagatg

SEQ ID NO: 36464 - DNA, 20 bp, Artificial Sequence
  Description of Artificial Sequence: Synthetic oligonucleotide
  Target: FXN; (+) strand; PAM type: YTN; PAM sequence: TTG
gcctattccggaaaagatgc

SEQ ID NO: 36465 - DNA, 20 bp, Artificial Sequence
  Description of Artificial Sequence: Synthetic oligonucleotide
  Target: FXN; (+) strand; PAM type: YTN; PAM sequence: CTA
ttccggaaaagatgcttgat

SEQ ID NO: 36466 - DNA, 20 bp, Artificial Sequence
  Description of Artificial Sequence: Synthetic oligonucleotide
  Target: FXN; (+) strand; PAM type: YTN; PAM sequence: TTC
cggaaaagatgcttgatgcc

SEQ ID NO: 36467 - DNA, 20 bp, Artificial Sequence
  Description of Artificial Sequence: Synthetic oligonucleotide
  Target: FXN; (+) strand; PAM type: YTN; PAM sequence: CTT
gatgcccagccccgttttaa

SEQ ID NO: 36468 - DNA, 20 bp, Artificial Sequence
  Description of Artificial Sequence: Synthetic oligonucleotide
  Target: FXN; (+) strand; PAM type: YTN; PAM sequence: TTG
atgcccagccccgttttaag

SEQ ID NO: 36469 - DNA, 20 bp, Artificial Sequence
  Description of Artificial Sequence: Synthetic oligonucleotide
  Target: FXN; (+) strand; PAM type: YTN; PAM sequence: TTT
taaggacattaaaagctatc

SEQ ID NO: 36470 - DNA, 20 bp, Artificial Sequence
  Description of Artificial Sequence: Synthetic oligonucleotide
  Target: FXN; (+) strand; PAM type: YTN; PAM sequence: TTT
aaggacattaaaagctatca

SEQ ID NO: 36471 - DNA, 20 bp, Artificial Sequence
  Description of Artificial Sequence: Synthetic oligonucleotide
  Target: FXN; (+) strand; PAM type: YTN; PAM sequence: TTA
aggacattaaaagctatcag

SEQ ID NO: 36472 - DNA, 20 bp, Artificial Sequence
  Description of Artificial Sequence: Synthetic oligonucleotide
  Target: FXN; (+) strand; PAM type: YTN; PAM sequence: TTA
aaagctatcaggccaagacc

SEQ ID NO: 36473 - DNA, 20 bp, Artificial Sequence
  Description of Artificial Sequence: Synthetic oligonucleotide
  Target: FXN; (+) strand; PAM type: YTN; PAM sequence: CTA
tcaggccaagaccccagctt

SEQ ID NO: 36474 - DNA, 20 bp, Artificial Sequence
  Description of Artificial Sequence: Synthetic oligonucleotide
  Target: FXN; (+) strand; PAM type: YTN; PAM sequence: CTT
cattatgcagctgaggtctg

SEQ ID NO: 36475 - DNA, 20 bp, Artificial Sequence
  Description of Artificial Sequence: Synthetic oligonucleotide
  Target: FXN; (+) strand; PAM type: YTN; PAM sequence: TTC
attatgcagctgaggtctgt

SEQ ID NO: 36476 - DNA, 20 bp, Artificial Sequence
  Description of Artificial Sequence: Synthetic oligonucleotide
  Target: FXN; (+) strand; PAM type: YTN; PAM sequence: TTA
tgcagctgaggtctgttttt

SEQ ID NO: 36477 - DNA, 20 bp, Artificial Sequence
  Description of Artificial Sequence: Synthetic oligonucleotide
  Target: FXN; (+) strand; PAM type: YTN; PAM sequence: CTG
aggtctgttttttgttgttg

SEQ ID NO: 36478 - DNA, 20 bp, Artificial Sequence
  Description of Artificial Sequence: Synthetic oligonucleotide
  Target: FXN; (+) strand; PAM type: YTN; PAM sequence: CTG
ttttttgttgttgttgttgt

SEQ ID NO: 36479 - DNA, 20 bp, Artificial Sequence
  Description of Artificial Sequence: Synthetic oligonucleotide
  Target: FXN; (+) strand; PAM type: YTN; PAM sequence: TTT
tttgttgttgttgttgttta

SEQ ID NO: 36480 - DNA, 20 bp, Artificial Sequence
  Description of Artificial Sequence: Synthetic oligonucleotide
  Target: FXN; (+) strand; PAM type: YTN; PAM sequence: TTT
ttgttgttgttgttgtttat

SEQ ID NO: 36481 - DNA, 20 bp, Artificial Sequence
  Description of Artificial Sequence: Synthetic oligonucleotide
  Target: FXN; (+) strand; PAM type: YTN; PAM sequence: TTT
tgttgttgttgttgtttatt

SEQ ID NO: 36482 - DNA, 20 bp, Artificial Sequence
  Description of Artificial Sequence: Synthetic oligonucleotide
  Target: FXN; (+) strand; PAM type: YTN; PAM sequence: TTT
gttgttgttgttgtttattt

SEQ ID NO: 36483 - DNA, 20 bp, Artificial Sequence
  Description of Artificial Sequence: Synthetic oligonucleotide
  Target: FXN; (+) strand; PAM type: YTN; PAM sequence: TTG
ttgttgttgttgtttatttt

SEQ ID NO: 36484 - DNA, 20 bp, Artificial Sequence
  Description of Artificial Sequence: Synthetic oligonucleotide
  Target: FXN; (+) strand; PAM type: YTN; PAM sequence: TTG
ttgttgttgtttattttttt

SEQ ID NO: 36485 - DNA, 20 bp, Artificial Sequence
  Description of Artificial Sequence: Synthetic oligonucleotide
  Target: FXN; (+) strand; PAM type: YTN; PAM sequence: TTG
ttgttgtttattttttttat

SEQ ID NO: 36486 - DNA, 20 bp, Artificial Sequence
  Description of Artificial Sequence: Synthetic oligonucleotide
  Target: FXN; (+) strand; PAM type: YTN; PAM sequence: TTG
ttgtttattttttttattcc

SEQ ID NO: 36487 - DNA, 20 bp, Artificial Sequence
  Description of Artificial Sequence: Synthetic oligonucleotide
  Target: FXN; (+) strand; PAM type: YTN; PAM sequence: TTG
tttattttttttattcctgc

SEQ ID NO: 36488 - DNA, 20 bp, Artificial Sequence
  Description of Artificial Sequence: Synthetic oligonucleotide
  Target: FXN; (+) strand; PAM type: YTN; PAM sequence: TTT
attttttttattcctgcttt

SEQ ID NO: 36489 - DNA, 20 bp, Artificial Sequence
  Description of Artificial Sequence: Synthetic oligonucleotide
  Target: FXN; (+) strand; PAM type: YTN; PAM sequence: TTA
ttttttttattcctgctttt

SEQ ID NO: 36490 - DNA, 20 bp, Artificial Sequence
  Description of Artificial Sequence: Synthetic oligonucleotide
  Target: FXN; (+) strand; PAM type: YTN; PAM sequence: TTT
tttttattcctgcttttgag

SEQ ID NO: 36491 - DNA, 20 bp, Artificial Sequence
  Description of Artificial Sequence: Synthetic oligonucleotide
  Target: FXN; (+) strand; PAM type: YTN; PAM sequence: TTT
ttttattcctgcttttgagg

SEQ ID NO: 36492 - DNA, 20 bp, Artificial Sequence
  Description of Artificial Sequence: Synthetic oligonucleotide
  Target: FXN; (+) strand; PAM type: YTN; PAM sequence: TTT
tttattcctgcttttgagga

SEQ ID NO: 36493 - DNA, 20 bp, Artificial Sequence
  Description of Artificial Sequence: Synthetic oligonucleotide
  Target: FXN; (+) strand; PAM type: YTN; PAM sequence: TTT
ttattcctgcttttgaggac

SEQ ID NO: 36494 - DNA, 20 bp, Artificial Sequence
  Description of Artificial Sequence: Synthetic oligonucleotide
  Target: FXN; (+) strand; PAM type: YTN; PAM sequence: TTT
tattcctgcttttgaggaca

SEQ ID NO: 36495 - DNA, 20 bp, Artificial Sequence
  Description of Artificial Sequence: Synthetic oligonucleotide
  Target: FXN; (+) strand; PAM type: YTN; PAM sequence: TTT
attcctgcttttgaggacag

SEQ ID NO: 36496 - DNA, 20 bp, Artificial Sequence
  Description of Artificial Sequence: Synthetic oligonucleotide
  Target: FXN; (+) strand; PAM type: YTN; PAM sequence: TTA
ttcctgcttttgaggacagt

SEQ ID NO: 36497 - DNA, 20 bp, Artificial Sequence
  Description of Artificial Sequence: Synthetic oligonucleotide
  Target: FXN; (+) strand; PAM type: YTN; PAM sequence: TTC
ctgcttttgaggacagttgg

SEQ ID NO: 36498 - DNA, 20 bp, Artificial Sequence
  Description of Artificial Sequence: Synthetic oligonucleotide
  Target: FXN; (+) strand; PAM type: YTN; PAM sequence: CTG
cttttgaggacagttgggct

SEQ ID NO: 36499 - DNA, 20 bp, Artificial Sequence
  Description of Artificial Sequence: Synthetic oligonucleotide
  Target: FXN; (+) strand; PAM type: YTN; PAM sequence: CTT
ttgaggacagttgggctatg

SEQ ID NO: 36500 - DNA, 20 bp, Artificial Sequence
  Description of Artificial Sequence: Synthetic oligonucleotide
  Target: FXN; (+) strand; PAM type: YTN; PAM sequence: TTT
tgaggacagttgggctatgt

SEQ ID NO: 36501 - DNA, 20 bp, Artificial Sequence
  Description of Artificial Sequence: Synthetic oligonucleotide
  Target: FXN; (+) strand; PAM type: YTN; PAM sequence: TTT
gaggacagttgggctatgtg

SEQ ID NO: 36502 - DNA, 20 bp, Artificial Sequence
  Description of Artificial Sequence: Synthetic oligonucleotide
  Target: FXN; (+) strand; PAM type: YTN; PAM sequence: TTG
aggacagttgggctatgtgt

SEQ ID NO: 36503 - DNA, 20 bp, Artificial Sequence
  Description of Artificial Sequence: Synthetic oligonucleotide
  Target: FXN; (+) strand; PAM type: YTN; PAM sequence: TTG
ggctatgtgtcacagctctg

SEQ ID NO: 36504 - DNA, 20 bp, Artificial Sequence
  Description of Artificial Sequence: Synthetic oligonucleotide
  Target: FXN; (+) strand; PAM type: YTN; PAM sequence: CTA
tgtgtcacagctctgtagaa

SEQ ID NO: 36505 - DNA, 20 bp, Artificial Sequence
  Description of Artificial Sequence: Synthetic oligonucleotide
  Target: FXN; (+) strand; PAM type: YTN; PAM sequence: CTC
tgtagaaagaatgtgttgcc

SEQ ID NO: 36506 - DNA, 20 bp, Artificial Sequence
  Description of Artificial Sequence: Synthetic oligonucleotide
  Target: FXN; (+) strand; PAM type: YTN; PAM sequence: CTG
tagaaagaatgtgttgcctc

SEQ ID NO: 36507 - DNA, 20 bp, Artificial Sequence
  Description of Artificial Sequence: Synthetic oligonucleotide
  Target: FXN; (+) strand; PAM type: YTN; PAM sequence: TTG
cctcctaccttgcccccaag

SEQ ID NO: 36508 - DNA, 20 bp, Artificial Sequence
  Description of Artificial Sequence: Synthetic oligonucleotide
  Target: FXN; (+) strand; PAM type: YTN; PAM sequence: CTC
ctaccttgcccccaagttct

SEQ ID NO: 36509 - DNA, 20 bp, Artificial Sequence
  Description of Artificial Sequence: Synthetic oligonucleotide
  Target: FXN; (+) strand; PAM type: YTN; PAM sequence: CTA
ccttgcccccaagttctgat

SEQ ID NO: 36510 - DNA, 20 bp, Artificial Sequence
  Description of Artificial Sequence: Synthetic oligonucleotide
  Target: FXN; (+) strand; PAM type: YTN; PAM sequence: CTT
gcccccaagttctgattttt

SEQ ID NO: 36511 - DNA, 20 bp, Artificial Sequence
  Description of Artificial Sequence: Synthetic oligonucleotide
  Target: FXN; (+) strand; PAM type: YTN; PAM sequence: TTG
cccccaagttctgattttta

SEQ ID NO: 36512 - DNA, 20 bp, Artificial Sequence
  Description of Artificial Sequence: Synthetic oligonucleotide
  Target: FXN; (+) strand; PAM type: YTN; PAM sequence: TTC
tgatttttaatttctatgga

SEQ ID NO: 36513 - DNA, 20 bp, Artificial Sequence
  Description of Artificial Sequence: Synthetic oligonucleotide
  Target: FXN; (+) strand; PAM type: YTN; PAM sequence: CTG
atttttaatttctatggaag

SEQ ID NO: 36514 - DNA, 20 bp, Artificial Sequence
  Description of Artificial Sequence: Synthetic oligonucleotide
  Target: FXN; (+) strand; PAM type: YTN; PAM sequence: TTT
ttaatttctatggaagattt

SEQ ID NO: 36515 - DNA, 20 bp, Artificial Sequence
  Description of Artificial Sequence: Synthetic oligonucleotide
  Target: FXN; (+) strand; PAM type: YTN; PAM sequence: TTT
taatttctatggaagatttt

SEQ ID NO: 36516 - DNA, 20 bp, Artificial Sequence
  Description of Artificial Sequence: Synthetic oligonucleotide
  Target: FXN; (+) strand; PAM type: YTN; PAM sequence: TTT
aatttctatggaagattttt

SEQ ID NO: 36517 - DNA, 20 bp, Artificial Sequence
  Description of Artificial Sequence: Synthetic oligonucleotide
  Target: FXN; (+) strand; PAM type: YTN; PAM sequence: TTA
atttctatggaagatttttt

SEQ ID NO: 36518 - DNA, 20 bp, Artificial Sequence
  Description of Artificial Sequence: Synthetic oligonucleotide
  Target: FXN; (+) strand; PAM type: YTN; PAM sequence: TTT
ctatggaagattttttggat

SEQ ID NO: 36519 - DNA, 20 bp, Artificial Sequence
  Description of Artificial Sequence: Synthetic oligonucleotide
  Target: FXN; (+) strand; PAM type: YTN; PAM sequence: TTC
tatggaagattttttggatt

SEQ ID NO: 36520 - DNA, 20 bp, Artificial Sequence
  Description of Artificial Sequence: Synthetic oligonucleotide
  Target: FXN; (+) strand; PAM type: YTN; PAM sequence: CTA
tggaagattttttggattgt

SEQ ID NO: 36521 - DNA, 20 bp, Artificial Sequence
  Description of Artificial Sequence: Synthetic oligonucleotide
  Target: FXN; (+) strand; PAM type: YTN; PAM sequence: TTT
tttggattgtcggatttcct

SEQ ID NO: 36522 - DNA, 20 bp, Artificial Sequence
  Description of Artificial Sequence: Synthetic oligonucleotide
  Target: FXN; (+) strand; PAM type: YTN; PAM sequence: TTT
ttggattgtcggatttcctc

SEQ ID NO: 36523 - DNA, 20 bp, Artificial Sequence
  Description of Artificial Sequence: Synthetic oligonucleotide
  Target: FXN; (+) strand; PAM type: YTN; PAM sequence: TTT
tggattgtcggatttcctcc

SEQ ID NO: 36524 - DNA, 20 bp, Artificial Sequence
  Description of Artificial Sequence: Synthetic oligonucleotide
  Target: FXN; (+) strand; PAM type: YTN; PAM sequence: TTT
ggattgtcggatttcctccc

SEQ ID NO: 36525 - DNA, 20 bp, Artificial Sequence
  Description of Artificial Sequence: Synthetic oligonucleotide
  Target: FXN; (+) strand; PAM type: YTN; PAM sequence: TTG
gattgtcggatttcctccct

SEQ ID NO: 36526 - DNA, 20 bp, Artificial Sequence
  Description of Artificial Sequence: Synthetic oligonucleotide
  Target: FXN; (+) strand; PAM type: YTN; PAM sequence: TTG
tcggatttcctccctcacat

SEQ ID NO: 36527 - DNA, 20 bp, Artificial Sequence
  Description of Artificial Sequence: Synthetic oligonucleotide
  Target: FXN; (+) strand; PAM type: YTN; PAM sequence: TTT
cctccctcacatgatacccc

SEQ ID NO: 36528 - DNA, 20 bp, Artificial Sequence
  Description of Artificial Sequence: Synthetic oligonucleotide
  Target: FXN; (+) strand; PAM type: YTN; PAM sequence: TTC
ctccctcacatgatacccct

SEQ ID NO: 36529 - DNA, 20 bp, Artificial Sequence
  Description of Artificial Sequence: Synthetic oligonucleotide
  Target: FXN; (+) strand; PAM type: YTN; PAM sequence: CTC
cctcacatgataccccttat

SEQ ID NO: 36530 - DNA, 20 bp, Artificial Sequence
  Description of Artificial Sequence: Synthetic oligonucleotide
  Target: FXN; (+) strand; PAM type: YTN; PAM sequence: CTC
acatgataccccttatcttt

SEQ ID NO: 36531 - DNA, 20 bp, Artificial Sequence
  Description of Artificial Sequence: Synthetic oligonucleotide
  Target: FXN; (+) strand; PAM type: YTN; PAM sequence: CTT
atcttttataatgtcttatg

SEQ ID NO: 36532 - DNA, 20 bp, Artificial Sequence
  Description of Artificial Sequence: Synthetic oligonucleotide
  Target: FXN; (+) strand; PAM type: YTN; PAM sequence: TTA
tcttttataatgtcttatgc

SEQ ID NO: 36533 - DNA, 20 bp, Artificial Sequence
  Description of Artificial Sequence: Synthetic oligonucleotide
  Target: FXN; (+) strand; PAM type: YTN; PAM sequence: CTT
ttataatgtcttatgcctat

SEQ ID NO: 36534 - DNA, 20 bp, Artificial Sequence
  Description of Artificial Sequence: Synthetic oligonucleotide
  Target: FXN; (+) strand; PAM type: YTN; PAM sequence: TTT
tataatgtcttatgcctata

SEQ ID NO: 36535 - DNA, 20 bp, Artificial Sequence
  Description of Artificial Sequence: Synthetic oligonucleotide
  Target: FXN; (+) strand; PAM type: YTN; PAM sequence: TTT
ataatgtcttatgcctatac

SEQ ID NO: 36536 - DNA, 20 bp, Artificial Sequence
  Description of Artificial Sequence: Synthetic oligonucleotide
  Target: FXN; (+) strand; PAM type: YTN; PAM sequence: TTA
taatgtcttatgcctatacc

SEQ ID NO: 36537 - DNA, 20 bp, Artificial Sequence
  Description of Artificial Sequence: Synthetic oligonucleotide
  Target: FXN; (+) strand; PAM type: YTN; PAM sequence: CTT
atgcctatacctgaatataa

SEQ ID NO: 36538 - DNA, 20 bp, Artificial Sequence
  Description of Artificial Sequence: Synthetic oligonucleotide
  Target: FXN; (+) strand; PAM type: YTN; PAM sequence: TTA
tgcctatacctgaatataac

SEQ ID NO: 36539 - DNA, 20 bp, Artificial Sequence
  Description of Artificial Sequence: Synthetic oligonucleotide
  Target: FXN; (+) strand; PAM type: YTN; PAM sequence: CTA
tacctgaatataacaacctt

SEQ ID NO: 36540 - DNA, 20 bp, Artificial Sequence
  Description of Artificial Sequence: Synthetic oligonucleotide
  Target: FXN; (+) strand; PAM type: YTN; PAM sequence: CTG
aatataacaacctttaaaaa

SEQ ID NO: 36541 - DNA, 20 bp, Artificial Sequence
  Description of Artificial Sequence: Synthetic oligonucleotide
  Target: FXN; (+) strand; PAM type: YTN; PAM sequence: CTT
taaaaaagcaaaataataag

SEQ ID NO: 36542 - DNA, 20 bp, Artificial Sequence
  Description of Artificial Sequence: Synthetic oligonucleotide
  Target: FXN; (+) strand; PAM type: YTN; PAM sequence: TTT
aaaaaagcaaaataataaga

SEQ ID NO: 36543 - DNA, 20 bp, Artificial Sequence
  Description of Artificial Sequence: Synthetic oligonucleotide
  Target: FXN; (+) strand; PAM type: YTN; PAM sequence: TTA
aaaaagcaaaataataagaa

SEQ ID NO: 36544 - DNA, 20 bp, Artificial Sequence
  Description of Artificial Sequence: Synthetic oligonucleotide
  Target: FXN; (+) strand; PAM type: YTN; PAM sequence: TTC
caggagggaaaatgaattgt

SEQ ID NO: 36545 - DNA, 20 bp, Artificial Sequence
  Description of Artificial Sequence: Synthetic oligonucleotide
  Target: FXN; (+) strand; PAM type: YTN; PAM sequence: TTG
tcttcactcttcattctttg

SEQ ID NO: 36546 - DNA, 20 bp, Artificial Sequence
  Description of Artificial Sequence: Synthetic oligonucleotide
  Target: FXN; (+) strand; PAM type: YTN; PAM sequence: CTT
cactcttcattctttgaagg

SEQ ID NO: 36547 - DNA, 20 bp, Artificial Sequence
  Description of Artificial Sequence: Synthetic oligonucleotide
  Target: FXN; (+) strand; PAM type: YTN; PAM sequence: TTC
actcttcattctttgaagga

SEQ ID NO: 36548 - DNA, 20 bp, Artificial Sequence
  Description of Artificial Sequence: Synthetic oligonucleotide
  Target: FXN; (+) strand; PAM type: YTN; PAM sequence: CTC
ttcattctttgaaggattta

SEQ ID NO: 36549 - DNA, 20 bp, Artificial Sequence
  Description of Artificial Sequence: Synthetic oligonucleotide
  Target: FXN; (+) strand; PAM type: YTN; PAM sequence: CTT
cattctttgaaggatttact

SEQ ID NO: 36550 - DNA, 20 bp, Artificial Sequence
  Description of Artificial Sequence: Synthetic oligonucleotide
  Target: FXN; (+) strand; PAM type: YTN; PAM sequence: TTC
attctttgaaggatttactg

SEQ ID NO: 36551 - DNA, 20 bp, Artificial Sequence
  Description of Artificial Sequence: Synthetic oligonucleotide
  Target: FXN; (+) strand; PAM type: YTN; PAM sequence: TTC
tttgaaggatttactgcaag

SEQ ID NO: 36552 - DNA, 20 bp, Artificial Sequence
  Description of Artificial Sequence: Synthetic oligonucleotide
  Target: FXN; (+) strand; PAM type: YTN; PAM sequence: CTT
tgaaggatttactgcaagaa

SEQ ID NO: 36553 - DNA, 20 bp, Artificial Sequence
  Description of Artificial Sequence: Synthetic oligonucleotide
  Target: FXN; (+) strand; PAM type: YTN; PAM sequence: TTT
gaaggatttactgcaagaag

SEQ ID NO: 36554 - DNA, 20 bp, Artificial Sequence
  Description of Artificial Sequence: Synthetic oligonucleotide
  Target: FXN; (+) strand; PAM type: YTN; PAM sequence: TTG
aaggatttactgcaagaagt

SEQ ID NO: 36555 - DNA, 20 bp, Artificial Sequence
  Description of Artificial Sequence: Synthetic oligonucleotide
  Target: FXN; (+) strand; PAM type: YTN; PAM sequence: TTT
actgcaagaagtacatgaag

SEQ ID NO: 36556 - DNA, 20 bp, Artificial Sequence
  Description of Artificial Sequence: Synthetic oligonucleotide
  Target: FXN; (+) strand; PAM type: YTN; PAM sequence: TTA
ctgcaagaagtacatgaaga

SEQ ID NO: 36557 - DNA, 20 bp, Artificial Sequence
  Description of Artificial Sequence: Synthetic oligonucleotide
  Target: FXN; (+) strand; PAM type: YTN; PAM sequence: CTG
caagaagtacatgaagagca

SEQ ID NO: 36558 - DNA, 20 bp, Artificial Sequence
  Description of Artificial Sequence: Synthetic oligonucleotide
  Target: FXN; (+) strand; PAM type: YTN; PAM sequence: CTG
gtcaacctgctcactgttct

SEQ ID NO: 36559 - DNA, 20 bp, Artificial Sequence
  Description of Artificial Sequence: Synthetic oligonucleotide
  Target: FXN; (+) strand; PAM type: YTN; PAM sequence: CTG
ctcactgttctatctccaaa

SEQ ID NO: 36560 - DNA, 20 bp, Artificial Sequence
  Description of Artificial Sequence: Synthetic oligonucleotide
  Target: FXN; (+) strand; PAM type: YTN; PAM sequence: CTC
actgttctatctccaaatga

SEQ ID NO: 36561 - DNA, 20 bp, Artificial Sequence
  Description of Artificial Sequence: Synthetic oligonucleotide
  Target: FXN; (+) strand; PAM type: YTN; PAM sequence: CTG
ttctatctccaaatgagaca

SEQ ID NO: 36562 - DNA, 20 bp, Artificial Sequence
  Description of Artificial Sequence: Synthetic oligonucleotide
  Target: FXN; (+) strand; PAM type: YTN; PAM sequence: TTC
tatctccaaatgagacacat

SEQ ID NO: 36563 - DNA, 20 bp, Artificial Sequence
  Description of Artificial Sequence: Synthetic oligonucleotide
  Target: FXN; (+) strand; PAM type: YTN; PAM sequence: CTA
tctccaaatgagacacatta

SEQ ID NO: 36564 - DNA, 20 bp, Artificial Sequence
  Description of Artificial Sequence: Synthetic oligonucleotide
  Target: FXN; (+) strand; PAM type: YTN; PAM sequence: CTC
caaatgagacacattaaagg

SEQ ID NO: 36565 - DNA, 20 bp, Artificial Sequence
  Description of Artificial Sequence: Synthetic oligonucleotide
  Target: FXN; (+) strand; PAM type: YTN; PAM sequence: TTA
aagggtagcctacaaatgtt

SEQ ID NO: 36566 - DNA, 20 bp, Artificial Sequence
  Description of Artificial Sequence: Synthetic oligonucleotide
  Target: FXN; (+) strand; PAM type: YTN; PAM sequence: CTA
caaatgttttcaggcttctt

SEQ ID NO: 36567 - DNA, 20 bp, Artificial Sequence
  Description of Artificial Sequence: Synthetic oligonucleotide
  Target: FXN; (+) strand; PAM type: YTN; PAM sequence: TTT
tcaggcttctttcaaagtgt

SEQ ID NO: 36568 - DNA, 20 bp, Artificial Sequence
  Description of Artificial Sequence: Synthetic oligonucleotide
  Target: FXN; (+) strand; PAM type: YTN; PAM sequence: TTT
caggcttctttcaaagtgta

SEQ ID NO: 36569 - DNA, 20 bp, Artificial Sequence
  Description of Artificial Sequence: Synthetic oligonucleotide
  Target: FXN; (+) strand; PAM type: YTN; PAM sequence: TTC
aggcttctttcaaagtgtaa

SEQ ID NO: 36570 - DNA, 20 bp, Artificial Sequence
  Description of Artificial Sequence: Synthetic oligonucleotide
  Target: FXN; (+) strand; PAM type: YTN; PAM sequence: CTT
ctttcaaagtgtaagcactt

SEQ ID NO: 36571 - DNA, 20 bp, Artificial Sequence
  Description of Artificial Sequence: Synthetic oligonucleotide
  Target: FXN; (+) strand; PAM type: YTN; PAM sequence: TTC
tttcaaagtgtaagcacttc

SEQ ID NO: 36572 - DNA, 20 bp, Artificial Sequence
  Description of Artificial Sequence: Synthetic oligonucleotide
  Target: FXN; (+) strand; PAM type: YTN; PAM sequence: CTT
tcaaagtgtaagcacttctg

SEQ ID NO: 36573 - DNA, 20 bp, Artificial Sequence
  Description of Artificial Sequence: Synthetic oligonucleotide
  Target: FXN; (+) strand; PAM type: YTN; PAM sequence: TTT
caaagtgtaagcacttctga

SEQ ID NO: 36574 - DNA, 20 bp, Artificial Sequence
  Description of Artificial Sequence: Synthetic oligonucleotide
  Target: FXN; (+) strand; PAM type: YTN; PAM sequence: TTC
aaagtgtaagcacttctgag

SEQ ID NO: 36575 - DNA, 20 bp, Artificial Sequence
  Description of Artificial Sequence: Synthetic oligonucleotide
  Target: FXN; (+) strand; PAM type: YTN; PAM sequence: CTT
ctgagctctttagcattgaa

SEQ ID NO: 36576 - DNA, 20 bp, Artificial Sequence
  Description of Artificial Sequence: Synthetic oligonucleotide
  Target: FXN; (+) strand; PAM type: YTN; PAM sequence: TTC
tgagctctttagcattgaag

SEQ ID NO: 36577 - DNA, 20 bp, Artificial Sequence
  Description of Artificial Sequence: Synthetic oligonucleotide
  Target: FXN; (+) strand; PAM type: YTN; PAM sequence: CTG
agctctttagcattgaagtg

SEQ ID NO: 36578 - DNA, 20 bp, Artificial Sequence
  Description of Artificial Sequence: Synthetic oligonucleotide
  Target: FXN; (+) strand; PAM type: YTN; PAM sequence: CTC
tttagcattgaagtgtcgaa

SEQ ID NO: 36579 - DNA, 20 bp, Artificial Sequence
  Description of Artificial Sequence: Synthetic oligonucleotide
  Target: FXN; (+) strand; PAM type: YTN; PAM sequence: CTT
tagcattgaagtgtcgaaag

SEQ ID NO: 36580 - DNA, 20 bp, Artificial Sequence
  Description of Artificial Sequence: Synthetic oligonucleotide
  Target: FXN; (+) strand; PAM type: YTN; PAM sequence: TTT
agcattgaagtgtcgaaagc

SEQ ID NO: 36581 - DNA, 20 bp, Artificial Sequence
  Description of Artificial Sequence: Synthetic oligonucleotide
  Target: FXN; (+) strand; PAM type: YTN; PAM sequence: TTA
gcattgaagtgtcgaaagca

SEQ ID NO: 36582 - DNA, 20 bp, Artificial Sequence
  Description of Artificial Sequence: Synthetic oligonucleotide
  Target: FXN; (+) strand; PAM type: YTN; PAM sequence: TTG
aagtgtcgaaagcaactcac

SEQ ID NO: 36583 - DNA, 20 bp, Artificial Sequence
  Description of Artificial Sequence: Synthetic oligonucleotide
  Target: FXN; (+) strand; PAM type: YTN; PAM sequence: CTC
acacgggaagatcatttctt

SEQ ID NO: 36584 - DNA, 20 bp, Artificial Sequence
  Description of Artificial Sequence: Synthetic oligonucleotide
  Target: FXN; (+) strand; PAM type: YTN; PAM sequence: TTT
cttatttgtgctctgtgact

SEQ ID NO: 36585 - DNA, 20 bp, Artificial Sequence
  Description of Artificial Sequence: Synthetic oligonucleotide
  Target: FXN; (+) strand; PAM type: YTN; PAM sequence: TTC
ttatttgtgctctgtgactg

SEQ ID NO: 36586 - DNA, 20 bp, Artificial Sequence
  Description of Artificial Sequence: Synthetic oligonucleotide
  Target: FXN; (+) strand; PAM type: YTN; PAM sequence: CTT
atttgtgctctgtgactgcc

SEQ ID NO: 36587 - DNA, 20 bp, Artificial Sequence
  Description of Artificial Sequence: Synthetic oligonucleotide
  Target: FXN; (+) strand; PAM type: YTN; PAM sequence: TTA
tttgtgctctgtgactgcca

SEQ ID NO: 36588 - DNA, 20 bp, Artificial Sequence
  Description of Artificial Sequence: Synthetic oligonucleotide
  Target: FXN; (+) strand; PAM type: YTN; PAM sequence: TTT
gtgctctgtgactgccaagg

SEQ ID NO: 36589 - DNA, 20 bp, Artificial Sequence
  Description of Artificial Sequence: Synthetic oligonucleotide
  Target: FXN; (+) strand; PAM type: YTN; PAM sequence: TTG
tgctctgtgactgccaaggt

SEQ ID NO: 36590 - DNA, 20 bp, Artificial Sequence
  Description of Artificial Sequence: Synthetic oligonucleotide
  Target: FXN; (+) strand; PAM type: YTN; PAM sequence: CTC
tgtgactgccaaggtgtggc

SEQ ID NO: 36591 - DNA, 20 bp, Artificial Sequence
  Description of Artificial Sequence: Synthetic oligonucleotide
  Target: FXN; (+) strand; PAM type: YTN; PAM sequence: CTG
tgactgccaaggtgtggcct

SEQ ID NO: 36592 - DNA, 20 bp, Artificial Sequence
  Description of Artificial Sequence: Synthetic oligonucleotide
  Target: FXN; (+) strand; PAM type: YTN; PAM sequence: CTG
ccaaggtgtggcctgcactg

SEQ ID NO: 36593 - DNA, 20 bp, Artificial Sequence
  Description of Artificial Sequence: Synthetic oligonucleotide
  Target: FXN; (+) strand; PAM type: YTN; PAM sequence: CTG
cactgggttgtccagggaga

SEQ ID NO: 36594 - DNA, 20 bp, Artificial Sequence
  Description of Artificial Sequence: Synthetic oligonucleotide
  Target: FXN; (+) strand; PAM type: YTN; PAM sequence: CTG
ggttgtccagggagacctag

SEQ ID NO: 36595 - DNA, 20 bp, Artificial Sequence
  Description of Artificial Sequence: Synthetic oligonucleotide
  Target: FXN; (+) strand; PAM type: YTN; PAM sequence: TTG
tccagggagacctagtgctg

SEQ ID NO: 36596 - DNA, 20 bp, Artificial Sequence
  Description of Artificial Sequence: Synthetic oligonucleotide
  Target: FXN; (+) strand; PAM type: YTN; PAM sequence: CTA
gtgctgtttctcccacatat

SEQ ID NO: 36597 - DNA, 20 bp, Artificial Sequence
  Description of Artificial Sequence: Synthetic oligonucleotide
  Target: FXN; (+) strand; PAM type: YTN; PAM sequence: CTG
tttctcccacatattcacat

SEQ ID NO: 36598 - DNA, 20 bp, Artificial Sequence
  Description of Artificial Sequence: Synthetic oligonucleotide
  Target: FXN; (+) strand; PAM type: YTN; PAM sequence: TTT
ctcccacatattcacatacg

SEQ ID NO: 36599 - DNA, 20 bp, Artificial Sequence
  Description of Artificial Sequence: Synthetic oligonucleotide
  Target: FXN; (+) strand; PAM type: YTN; PAM sequence: TTC
tcccacatattcacatacgt

SEQ ID NO: 36600 - DNA, 20 bp, Artificial Sequence
  Description of Artificial Sequence: Synthetic oligonucleotide
  Target: FXN; (+) strand; PAM type: YTN; PAM sequence: CTC
ccacatattcacatacgtgt

SEQ ID NO: 36601 - DNA, 20 bp, Artificial Sequence
  Description of Artificial Sequence: Synthetic oligonucleotide
  Target: FXN; (+) strand; PAM type: YTN; PAM sequence: TTC
acatacgtgtctgtgtgtat

SEQ ID NO: 36602 - DNA, 20 bp, Artificial Sequence
  Description of Artificial Sequence: Synthetic oligonucleotide
  Target: FXN; (+) strand; PAM type: YTN; PAM sequence: CTG
tgtgtatatatattttttca

SEQ ID NO: 36603 - DNA, 20 bp, Artificial Sequence
  Description of Artificial Sequence: Synthetic oligonucleotide
  Target: FXN; (+) strand; PAM type: YTN; PAM sequence: TTT
tttcaatttaaaggttagta

SEQ ID NO: 36604 - DNA, 20 bp, Artificial Sequence
  Description of Artificial Sequence: Synthetic oligonucleotide
  Target: FXN; (+) strand; PAM type: YTN; PAM sequence: TTT
ttcaatttaaaggttagtat

SEQ ID NO: 36605 - DNA, 20 bp, Artificial Sequence
  Description of Artificial Sequence: Synthetic oligonucleotide
  Target: FXN; (+) strand; PAM type: YTN; PAM sequence: TTT
tcaatttaaaggttagtatg

SEQ ID NO: 36606 - DNA, 20 bp, Artificial Sequence
  Description of Artificial Sequence: Synthetic oligonucleotide
  Target: FXN; (+) strand; PAM type: YTN; PAM sequence: TTT
caatttaaaggttagtatgg

SEQ ID NO: 36607 - DNA, 20 bp, Artificial Sequence
  Description of Artificial Sequence: Synthetic oligonucleotide
  Target: FXN; (+) strand; PAM type: YTN; PAM sequence: TTC
aatttaaaggttagtatgga

SEQ ID NO: 36608 - DNA, 20 bp, Artificial Sequence
  Description of Artificial Sequence: Synthetic oligonucleotide
  Target: FXN; (+) strand; PAM type: YTN; PAM sequence: TTT
aaaggttagtatggaatcag

SEQ ID NO: 36609 - DNA, 20 bp, Artificial Sequence
  Description of Artificial Sequence: Synthetic oligonucleotide
  Target: FXN; (+) strand; PAM type: YTN; PAM sequence: TTA
aaggttagtatggaatcagc

SEQ ID NO: 36610 - DNA, 20 bp, Artificial Sequence
  Description of Artificial Sequence: Synthetic oligonucleotide
  Target: FXN; (+) strand; PAM type: YTN; PAM sequence: TTA
gtatggaatcagctgctaca

SEQ ID NO: 36611 - DNA, 20 bp, Artificial Sequence
  Description of Artificial Sequence: Synthetic oligonucleotide
  Target: FXN; (+) strand; PAM type: YTN; PAM sequence: CTG
ctacaagaatgcaaaaaatc

SEQ ID NO: 36612 - DNA, 20 bp, Artificial Sequence
  Description of Artificial Sequence: Synthetic oligonucleotide
  Target: FXN; (+) strand; PAM type: YTN; PAM sequence: CTA
caagaatgcaaaaaatcttc

SEQ ID NO: 36613 - DNA, 20 bp, Artificial Sequence
  Description of Artificial Sequence: Synthetic oligonucleotide
  Target: FXN; (+) strand; PAM type: YTN; PAM sequence: CTT
ccaaagacaagaaaagagga

SEQ ID NO: 36614 - DNA, 20 bp, Artificial Sequence
  Description of Artificial Sequence: Synthetic oligonucleotide
  Target: FXN; (+) strand; PAM type: YTN; PAM sequence: TTC
caaagacaagaaaagaggaa

SEQ ID NO: 36615 - DNA, 20 bp, Artificial Sequence
  Description of Artificial Sequence: Synthetic oligonucleotide
  Target: FXN; (+) strand; PAM type: YTN; PAM sequence: TTT
tcatgagctgagtgatgtag

SEQ ID NO: 36616 - DNA, 20 bp, Artificial Sequence
  Description of Artificial Sequence: Synthetic oligonucleotide
  Target: FXN; (+) strand; PAM type: YTN; PAM sequence: TTT
catgagctgagtgatgtagc

SEQ ID NO: 36617 - DNA, 20 bp, Artificial Sequence
  Description of Artificial Sequence: Synthetic oligonucleotide
  Target: FXN; (+) strand; PAM type: YTN; PAM sequence: TTC
atgagctgagtgatgtagcg

SEQ ID NO: 36618 - DNA, 20 bp, Artificial Sequence
  Description of Artificial Sequence: Synthetic oligonucleotide
  Target: FXN; (+) strand; PAM type: YTN; PAM sequence: CTG
agtgatgtagcgtaacaaac

SEQ ID NO: 36619 - DNA, 20 bp, Artificial Sequence
  Description of Artificial Sequence: Synthetic oligonucleotide
  Target: FXN; (+) strand; PAM type: YTN; PAM sequence: CTG
aggaggtgccttgtaaacat

SEQ ID NO: 36620 - DNA, 20 bp, Artificial Sequence
  Description of Artificial Sequence: Synthetic oligonucleotide
  Target: FXN; (+) strand; PAM type: YTN; PAM sequence: CTT
gtaaacatgaaggggcagat

SEQ ID NO: 36621 - DNA, 20 bp, Artificial Sequence
  Description of Artificial Sequence: Synthetic oligonucleotide
  Target: FXN; (+) strand; PAM type: YTN; PAM sequence: TTG
taaacatgaaggggcagata

SEQ ID NO: 36622 - DNA, 20 bp, Artificial Sequence
  Description of Artificial Sequence: Synthetic oligonucleotide
  Target: FXN; (+) strand; PAM type: YTN; PAM sequence: CTC
atgttgataaagagagccct

SEQ ID NO: 36623 - DNA, 20 bp, Artificial Sequence
  Description of Artificial Sequence: Synthetic oligonucleotide
  Target: FXN; (+) strand; PAM type: YTN; PAM sequence: TTG
ataaagagagccctggtcct

SEQ ID NO: 36624 - DNA, 20 bp, Artificial Sequence
  Description of Artificial Sequence: Synthetic oligonucleotide
  Target: FXN; (+) strand; PAM type: YTN; PAM sequence: CTG
gtcctagacatagttcagcc

SEQ ID NO: 36625 - DNA, 20 bp, Artificial Sequence
  Description of Artificial Sequence: Synthetic oligonucleotide
  Target: FXN; (+) strand; PAM type: YTN; PAM sequence: CTA
gacatagttcagccacaaag

SEQ ID NO: 36626 - DNA, 20 bp, Artificial Sequence
  Description of Artificial Sequence: Synthetic oligonucleotide
  Target: FXN; (+) strand; PAM type: YTN; PAM sequence: TTC
agccacaaagtagttgtccc

SEQ ID NO: 36627 - DNA, 20 bp, Artificial Sequence
  Description of Artificial Sequence: Synthetic oligonucleotide
  Target: FXN; (+) strand; PAM type: YTN; PAM sequence: TTG
tccctttgtggacaagtttc

SEQ ID NO: 36628 - DNA, 20 bp, Artificial Sequence
  Description of Artificial Sequence: Synthetic oligonucleotide
  Target: FXN; (+) strand; PAM type: YTN; PAM sequence: CTT
tgtggacaagtttcccaaat

SEQ ID NO: 36629 - DNA, 20 bp, Artificial Sequence
  Description of Artificial Sequence: Synthetic oligonucleotide
  Target: FXN; (+) strand; PAM type: YTN; PAM sequence: TTT
gtggacaagtttcccaaatt

SEQ ID NO: 36630 - DNA, 20 bp, Artificial Sequence
  Description of Artificial Sequence: Synthetic oligonucleotide
  Target: FXN; (+) strand; PAM type: YTN; PAM sequence: TTG
tggacaagtttcccaaattc

SEQ ID NO: 36631 - DNA, 20 bp, Artificial Sequence
  Description of Artificial Sequence: Synthetic oligonucleotide
  Target: FXN; (+) strand; PAM type: YTN; PAM sequence: TTT
cccaaattccctggacctct

SEQ ID NO: 36632 - DNA, 20 bp, Artificial Sequence
  Description of Artificial Sequence: Synthetic oligonucleotide
  Target: FXN; (+) strand; PAM type: YTN; PAM sequence: TTC
ccaaattccctggacctctg

SEQ ID NO: 36633 - DNA, 20 bp, Artificial Sequence
  Description of Artificial Sequence: Synthetic oligonucleotide
  Target: FXN; (+) strand; PAM type: YTN; PAM sequence: TTC
cctggacctctgcttcccca

SEQ ID NO: 36634 - DNA, 20 bp, Artificial Sequence
  Description of Artificial Sequence: Synthetic oligonucleotide
  Target: FXN; (+) strand; PAM type: YTN; PAM sequence: CTG
gacctctgcttccccatctg

SEQ ID NO: 36635 - DNA, 20 bp, Artificial Sequence
  Description of Artificial Sequence: Synthetic oligonucleotide
  Target: FXN; (+) strand; PAM type: YTN; PAM sequence: CTC
tgcttccccatctgttaaat

SEQ ID NO: 36636 - DNA, 20 bp, Artificial Sequence
  Description of Artificial Sequence: Synthetic oligonucleotide
  Target: FXN; (+) strand; PAM type: YTN; PAM sequence: CTG
cttccccatctgttaaatga

SEQ ID NO: 36637 - DNA, 20 bp, Artificial Sequence
  Description of Artificial Sequence: Synthetic oligonucleotide
  Target: FXN; (+) strand; PAM type: YTN; PAM sequence: CTT
ccccatctgttaaatgagag

SEQ ID NO: 36638 - DNA, 20 bp, Artificial Sequence
  Description of Artificial Sequence: Synthetic oligonucleotide
  Target: FXN; (+) strand; PAM type: YTN; PAM sequence: TTC
cccatctgttaaatgagaga

SEQ ID NO: 36639 - DNA, 20 bp, Artificial Sequence
  Description of Artificial Sequence: Synthetic oligonucleotide
  Target: FXN; (+) strand; PAM type: YTN; PAM sequence: CTG
ttaaatgagagaatagagta

SEQ ID NO: 36640 - DNA, 20 bp, Artificial Sequence
  Description of Artificial Sequence: Synthetic oligonucleotide
  Target: FXN; (+) strand; PAM type: YTN; PAM sequence: TTA
aatgagagaatagagtatgg

SEQ ID NO: 36641 - DNA, 20 bp, Artificial Sequence
  Description of Artificial Sequence: Synthetic oligonucleotide
  Target: FXN; (+) strand; PAM type: YTN; PAM sequence: TTG
attcccagcattcagtggtc

SEQ ID NO: 36642 - DNA, 20 bp, Artificial Sequence
  Description of Artificial Sequence: Synthetic oligonucleotide
  Target: FXN; (+) strand; PAM type: YTN; PAM sequence: TTC
ccagcattcagtggtcctgt

SEQ ID NO: 36643 - DNA, 20 bp, Artificial Sequence
  Description of Artificial Sequence: Synthetic oligonucleotide
  Target: FXN; (+) strand; PAM type: YTN; PAM sequence: TTC
agtggtcctgtcaagcaacc

SEQ ID NO: 36644 - DNA, 20 bp, Artificial Sequence
  Description of Artificial Sequence: Synthetic oligonucleotide
  Target: FXN; (+) strand; PAM type: YTN; PAM sequence: CTG
tcaagcaacctaacaggcta

SEQ ID NO: 36645 - DNA, 20 bp, Artificial Sequence
  Description of Artificial Sequence: Synthetic oligonucleotide
  Target: FXN; (+) strand; PAM type: YTN; PAM sequence: CTA
acaggctagttctaattccc

SEQ ID NO: 36646 - DNA, 20 bp, Artificial Sequence
  Description of Artificial Sequence: Synthetic oligonucleotide
  Target: FXN; (+) strand; PAM type: YTN; PAM sequence: CTA
gttctaattccctattgggt

SEQ ID NO: 36647 - DNA, 20 bp, Artificial Sequence
  Description of Artificial Sequence: Synthetic oligonucleotide
  Target: FXN; (+) strand; PAM type: YTN; PAM sequence: TTC
taattccctattgggtagat

SEQ ID NO: 36648 - DNA, 20 bp, Artificial Sequence
  Description of Artificial Sequence: Synthetic oligonucleotide
  Target: FXN; (+) strand; PAM type: YTN; PAM sequence: CTA
attccctattgggtagatga

SEQ ID NO: 36649 - DNA, 20 bp, Artificial Sequence
  Description of Artificial Sequence: Synthetic oligonucleotide
  Target: FXN; (+) strand; PAM type: YTN; PAM sequence: TTC
cctattgggtagatgagggg

SEQ ID NO: 36650 - DNA, 20 bp, Artificial Sequence
  Description of Artificial Sequence: Synthetic oligonucleotide
  Target: FXN; (+) strand; PAM type: YTN; PAM sequence: CTA
ttgggtagatgaggggatga

SEQ ID NO: 36651 - DNA, 20 bp, Artificial Sequence
  Description of Artificial Sequence: Synthetic oligonucleotide
  Target: FXN; (+) strand; PAM type: YTN; PAM sequence: TTG
ggtagatgaggggatgacaa

SEQ ID NO: 36652 - DNA, 20 bp, Artificial Sequence
  Description of Artificial Sequence: Synthetic oligonucleotide
  Target: FXN; (+) strand; PAM type: YTN; PAM sequence: TTT
ttaagctatataggaaacat

SEQ ID NO: 36653 - DNA, 20 bp, Artificial Sequence
  Description of Artificial Sequence: Synthetic oligonucleotide
  Target: FXN; (+) strand; PAM type: YTN; PAM sequence: TTT
taagctatataggaaacatt

SEQ ID NO: 36654 - DNA, 20 bp, Artificial Sequence
  Description of Artificial Sequence: Synthetic oligonucleotide
  Target: FXN; (+) strand; PAM type: YTN; PAM sequence: TTT
aagctatataggaaacattg

SEQ ID NO: 36655 - DNA, 20 bp, Artificial Sequence
  Description of Artificial Sequence: Synthetic oligonucleotide
  Target: FXN; (+) strand; PAM type: YTN; PAM sequence: TTA
agctatataggaaacattgt

SEQ ID NO: 36656 - DNA, 20 bp, Artificial Sequence
  Description of Artificial Sequence: Synthetic oligonucleotide
  Target: FXN; (+) strand; PAM type: YTN; PAM sequence: CTA
tataggaaacattgttattg

SEQ ID NO: 36657 - DNA, 20 bp, Artificial Sequence
  Description of Artificial Sequence: Synthetic oligonucleotide
  Target: FXN; (+) strand; PAM type: YTN; PAM sequence: TTG
ttattggtgttgccctatcg

SEQ ID NO: 36658 - DNA, 20 bp, Artificial Sequence
  Description of Artificial Sequence: Synthetic oligonucleotide
  Target: FXN; (+) strand; PAM type: YTN; PAM sequence: TTA
ttggtgttgccctatcgtga

SEQ ID NO: 36659 - DNA, 20 bp, Artificial Sequence
  Description of Artificial Sequence: Synthetic oligonucleotide
  Target: FXN; (+) strand; PAM type: YTN; PAM sequence: TTG
gtgttgccctatcgtgattt

SEQ ID NO: 36660 - DNA, 20 bp, Artificial Sequence
  Description of Artificial Sequence: Synthetic oligonucleotide
  Target: FXN; (+) strand; PAM type: YTN; PAM sequence: TTG
ccctatcgtgatttcagttg

SEQ ID NO: 36661 - DNA, 20 bp, Artificial Sequence
  Description of Artificial Sequence: Synthetic oligonucleotide
  Target: FXN; (+) strand; PAM type: YTN; PAM sequence: CTA
tcgtgatttcagttgaattc

SEQ ID NO: 36662 - DNA, 20 bp, Artificial Sequence
  Description of Artificial Sequence: Synthetic oligonucleotide
  Target: FXN; (+) strand; PAM type: YTN; PAM sequence: TTT
cagttgaattcatgtgaaaa

SEQ ID NO: 36663 - DNA, 20 bp, Artificial Sequence
  Description of Artificial Sequence: Synthetic oligonucleotide
  Target: FXN; (+) strand; PAM type: YTN; PAM sequence: TTC
agttgaattcatgtgaaaat

SEQ ID NO: 36664 - DNA, 20 bp, Artificial Sequence
  Description of Artificial Sequence: Synthetic oligonucleotide
  Target: FXN; (+) strand; PAM type: YTN; PAM sequence: TTG
aattcatgtgaaaataatag

SEQ ID NO: 36665 - DNA, 20 bp, Artificial Sequence
  Description of Artificial Sequence: Synthetic oligonucleotide
  Target: FXN; (+) strand; PAM type: YTN; PAM sequence: TTC
atgtgaaaataatagccatc

SEQ ID NO: 36666 - DNA, 20 bp, Artificial Sequence
  Description of Artificial Sequence: Synthetic oligonucleotide
  Target: FXN; (+) strand; PAM type: YTN; PAM sequence: CTT
ggcctggcgcggtggctcac

SEQ ID NO: 36667 - DNA, 20 bp, Artificial Sequence
  Description of Artificial Sequence: Synthetic oligonucleotide
  Target: FXN; (+) strand; PAM type: YTN; PAM sequence: TTG
gcctggcgcggtggctcaca

SEQ ID NO: 36668 - DNA, 20 bp, Artificial Sequence
  Description of Artificial Sequence: Synthetic oligonucleotide
  Target: FXN; (+) strand; PAM type: YTN; PAM sequence: CTG
gcgcggtggctcacacctgt

SEQ ID NO: 36669 - DNA, 20 bp, Artificial Sequence
  Description of Artificial Sequence: Synthetic oligonucleotide
  Target: FXN; (+) strand; PAM type: YTN; PAM sequence: CTC
acacctgtaatcccagcact

SEQ ID NO: 36670 - DNA, 20 bp, Artificial Sequence
  Description of Artificial Sequence: Synthetic oligonucleotide
  Target: FXN; (+) strand; PAM type: YTN; PAM sequence: CTG
taatcccagcacttttggag

SEQ ID NO: 36671 - DNA, 20 bp, Artificial Sequence
  Description of Artificial Sequence: Synthetic oligonucleotide
  Target: FXN; (+) strand; PAM type: YTN; PAM sequence: CTT
ttggaggccaaggtgggtgg

SEQ ID NO: 36672 - DNA, 20 bp, Artificial Sequence
  Description of Artificial Sequence: Synthetic oligonucleotide
  Target: FXN; (+) strand; PAM type: YTN; PAM sequence: TTT
tggaggccaaggtgggtgga

SEQ ID NO: 36673 - DNA, 20 bp, Artificial Sequence
  Description of Artificial Sequence: Synthetic oligonucleotide
  Target: FXN; (+) strand; PAM type: YTN; PAM sequence: TTT
ggaggccaaggtgggtggat

SEQ ID NO: 36674 - DNA, 20 bp, Artificial Sequence
  Description of Artificial Sequence: Synthetic oligonucleotide
  Target: FXN; (+) strand; PAM type: YTN; PAM sequence: TTG
gaggccaaggtgggtggatc

SEQ ID NO: 36675 - DNA, 20 bp, Artificial Sequence
  Description of Artificial Sequence: Synthetic oligonucleotide
  Target: FXN; (+) strand; PAM type: YTN; PAM sequence: CTG
aggtcaggagttcaagacca

SEQ ID NO: 36676 - DNA, 20 bp, Artificial Sequence
  Description of Artificial Sequence: Synthetic oligonucleotide
  Target: FXN; (+) strand; PAM type: YTN; PAM sequence: TTC
aagaccagcctggccaacat

SEQ ID NO: 36677 - DNA, 20 bp, Artificial Sequence
  Description of Artificial Sequence: Synthetic oligonucleotide
  Target: FXN; (+) strand; PAM type: YTN; PAM sequence: CTG
gccaacatgatgaaaccccg

SEQ ID NO: 36678 - DNA, 20 bp, Artificial Sequence
  Description of Artificial Sequence: Synthetic oligonucleotide
  Target: FXN; (+) strand; PAM type: YTN; PAM sequence: CTC
tactaaaaatacaaaaaatt

SEQ ID NO: 36679 - DNA, 20 bp, Artificial Sequence
  Description of Artificial Sequence: Synthetic oligonucleotide
  Target: FXN; (+) strand; PAM type: YTN; PAM sequence: CTA
ctaaaaatacaaaaaattag

SEQ ID NO: 36680 - DNA, 20 bp, Artificial Sequence
  Description of Artificial Sequence: Synthetic oligonucleotide
  Target: FXN; (+) strand; PAM type: YTN; PAM sequence: CTA
aaaatacaaaaaattagccg

SEQ ID NO: 36681 - DNA, 20 bp, Artificial Sequence
  Description of Artificial Sequence: Synthetic oligonucleotide
  Target: FXN; (+) strand; PAM type: YTN; PAM sequence: TTA
gccgggcatgatggcaggtg

SEQ ID NO: 36682 - DNA, 20 bp, Artificial Sequence
  Description of Artificial Sequence: Synthetic oligonucleotide
  Target: FXN; (+) strand; PAM type: YTN; PAM sequence: CTG
taatcccagctacttgggag

SEQ ID NO: 36683 - DNA, 20 bp, Artificial Sequence
  Description of Artificial Sequence: Synthetic oligonucleotide
  Target: FXN; (+) strand; PAM type: YTN; PAM sequence: CTA
cttgggaggctgaagcggaa

SEQ ID NO: 36684 - DNA, 20 bp, Artificial Sequence
  Description of Artificial Sequence: Synthetic oligonucleotide
  Target: FXN; (+) strand; PAM type: YTN; PAM sequence: CTT
gggaggctgaagcggaagaa

SEQ ID NO: 36685 - DNA, 20 bp, Artificial Sequence
  Description of Artificial Sequence: Synthetic oligonucleotide
  Target: FXN; (+) strand; PAM type: YTN; PAM sequence: TTG
ggaggctgaagcggaagaat

SEQ ID NO: 36686 - DNA, 20 bp, Artificial Sequence
  Description of Artificial Sequence: Synthetic oligonucleotide
  Target: FXN; (+) strand; PAM type: YTN; PAM sequence: CTG
aagcggaagaatcgcttgaa

SEQ ID NO: 36687 - DNA, 20 bp, Artificial Sequence
  Description of Artificial Sequence: Synthetic oligonucleotide
  Target: FXN; (+) strand; PAM type: YTN; PAM sequence: CTT
gaacccagaggtggaggttg

SEQ ID NO: 36688 - DNA, 20 bp, Artificial Sequence
  Description of Artificial Sequence: Synthetic oligonucleotide
  Target: FXN; (+) strand; PAM type: YTN; PAM sequence: TTG
aacccagaggtggaggttgc

SEQ ID NO: 36689 - DNA, 20 bp, Artificial Sequence
  Description of Artificial Sequence: Synthetic oligonucleotide
  Target: FXN; (+) strand; PAM type: YTN; PAM sequence: TTG
cagtgagccgagatcgtgcc

SEQ ID NO: 36690 - DNA, 20 bp, Artificial Sequence
  Description of Artificial Sequence: Synthetic oligonucleotide
  Target: FXN; (+) strand; PAM type: YTN; PAM sequence: TTG
cactgtaacctgggtgactg

SEQ ID NO: 36691 - DNA, 20 bp, Artificial Sequence
  Description of Artificial Sequence: Synthetic oligonucleotide
  Target: FXN; (+) strand; PAM type: YTN; PAM sequence: CTG
taacctgggtgactgagcaa

SEQ ID NO: 36692 - DNA, 20 bp, Artificial Sequence
  Description of Artificial Sequence: Synthetic oligonucleotide
  Target: FXN; (+) strand; PAM type: YTN; PAM sequence: CTG
ggtgactgagcaaaactctg

SEQ ID NO: 36693 - DNA, 20 bp, Artificial Sequence
  Description of Artificial Sequence: Synthetic oligonucleotide
  Target: FXN; (+) strand; PAM type: YTN; PAM sequence: CTG
agcaaaactctgtctcaaaa

SEQ ID NO: 36694 - DNA, 20 bp, Artificial Sequence
  Description of Artificial Sequence: Synthetic oligonucleotide
  Target: FXN; (+) strand; PAM type: YTN; PAM sequence: CTC
tgtctcaaaataataataac

SEQ ID NO: 36695 - DNA, 20 bp, Artificial Sequence
  Description of Artificial Sequence: Synthetic oligonucleotide
  Target: FXN; (+) strand; PAM type: YTN; PAM sequence: CTG
tctcaaaataataataacaa

SEQ ID NO: 36696 - DNA, 20 bp, Artificial Sequence
  Description of Artificial Sequence: Synthetic oligonucleotide
  Target: FXN; (+) strand; PAM type: YTN; PAM sequence: CTC
aaaataataataacaatata

SEQ ID NO: 36697 - DNA, 20 bp, Artificial Sequence
  Description of Artificial Sequence: Synthetic oligonucleotide
  Target: FXN; (+) strand; PAM type: YTN; PAM sequence: CTT
tattgtacccttactgggtt

SEQ ID NO: 36698 - DNA, 20 bp, Artificial Sequence
  Description of Artificial Sequence: Synthetic oligonucleotide
  Target: FXN; (+) strand; PAM type: YTN; PAM sequence: TTT
attgtacccttactgggtta

SEQ ID NO: 36699 - DNA, 20 bp, Artificial Sequence
  Description of Artificial Sequence: Synthetic oligonucleotide
  Target: FXN; (+) strand; PAM type: YTN; PAM sequence: TTA
ttgtacccttactgggttaa

SEQ ID NO: 36700 - DNA, 20 bp, Artificial Sequence
  Description of Artificial Sequence: Synthetic oligonucleotide
  Target: FXN; (+) strand; PAM type: YTN; PAM sequence: TTG
tacccttactgggttaatcg

SEQ ID NO: 36701 - DNA, 20 bp, Artificial Sequence
  Description of Artificial Sequence: Synthetic oligonucleotide
  Target: FXN; (+) strand; PAM type: YTN; PAM sequence: CTT
actgggttaatcgtattata

SEQ ID NO: 36702 - DNA, 20 bp, Artificial Sequence
  Description of Artificial Sequence: Synthetic oligonucleotide
  Target: FXN; (+) strand; PAM type: YTN; PAM sequence: TTA
ctgggttaatcgtattatac

SEQ ID NO: 36703 - DNA, 20 bp, Artificial Sequence
  Description of Artificial Sequence: Synthetic oligonucleotide
  Target: FXN; (+) strand; PAM type: YTN; PAM sequence: CTG
ggttaatcgtattataccac

SEQ ID NO: 36704 - DNA, 20 bp, Artificial Sequence
  Description of Artificial Sequence: Synthetic oligonucleotide
  Target: FXN; (+) strand; PAM type: YTN; PAM sequence: TTA
atcgtattataccacattac

SEQ ID NO: 36705 - DNA, 20 bp, Artificial Sequence
  Description of Artificial Sequence: Synthetic oligonucleotide
  Target: FXN; (+) strand; PAM type: YTN; PAM sequence: TTA
taccacattacctcatttta

SEQ ID NO: 36706 - DNA, 20 bp, Artificial Sequence
  Description of Artificial Sequence: Synthetic oligonucleotide
  Target: FXN; (+) strand; PAM type: YTN; PAM sequence: TTA
cctcattttaatttttactg

SEQ ID NO: 36707 - DNA, 20 bp, Artificial Sequence
  Description of Artificial Sequence: Synthetic oligonucleotide
  Target: FXN; (+) strand; PAM type: YTN; PAM sequence: CTC
attttaatttttactgacct

SEQ ID NO: 36708 - DNA, 20 bp, Artificial Sequence
  Description of Artificial Sequence: Synthetic oligonucleotide
  Target: FXN; (+) strand; PAM type: YTN; PAM sequence: TTT
taatttttactgacctgcac

SEQ ID NO: 36709 - DNA, 20 bp, Artificial Sequence
  Description of Artificial Sequence: Synthetic oligonucleotide
  Target: FXN; (+) strand; PAM type: YTN; PAM sequence: TTT
aatttttactgacctgcact

SEQ ID NO: 36710 - DNA, 20 bp, Artificial Sequence
  Description of Artificial Sequence: Synthetic oligonucleotide
  Target: FXN; (+) strand; PAM type: YTN; PAM sequence: TTA
atttttactgacctgcactt

SEQ ID NO: 36711 - DNA, 20 bp, Artificial Sequence
  Description of Artificial Sequence: Synthetic oligonucleotide
  Target: FXN; (+) strand; PAM type: YTN; PAM sequence: TTT
ttactgacctgcactttata

SEQ ID NO: 36712 - DNA, 20 bp, Artificial Sequence
  Description of Artificial Sequence: Synthetic oligonucleotide
  Target: FXN; (+) strand; PAM type: YTN; PAM sequence: TTT
tactgacctgcactttatac

SEQ ID NO: 36713 - DNA, 20 bp, Artificial Sequence
  Description of Artificial Sequence: Synthetic oligonucleotide
  Target: FXN; (+) strand; PAM type: YTN; PAM sequence: TTT
actgacctgcactttataca

SEQ ID NO: 36714 - DNA, 20 bp, Artificial Sequence
  Description of Artificial Sequence: Synthetic oligonucleotide
  Target: FXN; (+) strand; PAM type: YTN; PAM sequence: TTA
ctgacctgcactttatacaa

SEQ ID NO: 36715 - DNA, 20 bp, Artificial Sequence
  Description of Artificial Sequence: Synthetic oligonucleotide
  Target: FXN; (+) strand; PAM type: YTN; PAM sequence: CTG
acctgcactttatacaaagc

SEQ ID NO: 36716 - DNA, 20 bp, Artificial Sequence
  Description of Artificial Sequence: Synthetic oligonucleotide
  Target: FXN; (+) strand; PAM type: YTN; PAM sequence: CTG
cactttatacaaagcaacaa

SEQ ID NO: 36717 - DNA, 20 bp, Artificial Sequence
  Description of Artificial Sequence: Synthetic oligonucleotide
  Target: FXN; (+) strand; PAM type: YTN; PAM sequence: CTT
tatacaaagcaacaagcctc

SEQ ID NO: 36718 - DNA, 20 bp, Artificial Sequence
  Description of Artificial Sequence: Synthetic oligonucleotide
  Target: FXN; (+) strand; PAM type: YTN; PAM sequence: TTT
atacaaagcaacaagcctcc

SEQ ID NO: 36719 - DNA, 20 bp, Artificial Sequence
  Description of Artificial Sequence: Synthetic oligonucleotide
  Target: FXN; (+) strand; PAM type: YTN; PAM sequence: TTA
tacaaagcaacaagcctcca

SEQ ID NO: 36720 - DNA, 20 bp, Artificial Sequence
  Description of Artificial Sequence: Synthetic oligonucleotide
  Target: FXN; (+) strand; PAM type: YTN; PAM sequence: CTC
caggacattaaaattcatgc

SEQ ID NO: 36721 - DNA, 20 bp, Artificial Sequence
  Description of Artificial Sequence: Synthetic oligonucleotide
  Target: FXN; (+) strand; PAM type: YTN; PAM sequence: TTA
aaattcatgcaaagttatgc

SEQ ID NO: 36722 - DNA, 20 bp, Artificial Sequence
  Description of Artificial Sequence: Synthetic oligonucleotide
  Target: FXN; (+) strand; PAM type: YTN; PAM sequence: TTC
atgcaaagttatgctcatgt

SEQ ID NO: 36723 - DNA, 20 bp, Artificial Sequence
  Description of Artificial Sequence: Synthetic oligonucleotide
  Target: FXN; (+) strand; PAM type: YTN; PAM sequence: TTA
tgctcatgttatattatttt

SEQ ID NO: 36724 - DNA, 20 bp, Artificial Sequence
  Description of Artificial Sequence: Synthetic oligonucleotide
  Target: FXN; (+) strand; PAM type: YTN; PAM sequence: CTC
atgttatattattttcttac

SEQ ID NO: 36725 - DNA, 20 bp, Artificial Sequence
  Description of Artificial Sequence: Synthetic oligonucleotide
  Target: FXN; (+) strand; PAM type: YTN; PAM sequence: TTA
tattattttcttacttaaag

SEQ ID NO: 36726 - DNA, 20 bp, Artificial Sequence
  Description of Artificial Sequence: Synthetic oligonucleotide
  Target: FXN; (+) strand; PAM type: YTN; PAM sequence: TTA
ttttcttacttaaagaagga

SEQ ID NO: 36727 - DNA, 20 bp, Artificial Sequence
  Description of Artificial Sequence: Synthetic oligonucleotide
  Target: FXN; (+) strand; PAM type: YTN; PAM sequence: TTT
tcttacttaaagaaggattt

SEQ ID NO: 36728 - DNA, 20 bp, Artificial Sequence
  Description of Artificial Sequence: Synthetic oligonucleotide
  Target: FXN; (+) strand; PAM type: YTN; PAM sequence: TTT
cttacttaaagaaggattta

SEQ ID NO: 36729 - DNA, 20 bp, Artificial Sequence
  Description of Artificial Sequence: Synthetic oligonucleotide
  Target: FXN; (+) strand; PAM type: YTN; PAM sequence: TTC
ttacttaaagaaggatttat

SEQ ID NO: 36730 - DNA, 20 bp, Artificial Sequence
  Description of Artificial Sequence: Synthetic oligonucleotide
  Target: FXN; (+) strand; PAM type: YTN; PAM sequence: CTT
acttaaagaaggatttatta

SEQ ID NO: 36731 - DNA, 20 bp, Artificial Sequence
  Description of Artificial Sequence: Synthetic oligonucleotide
  Target: FXN; (+) strand; PAM type: YTN; PAM sequence: TTA
cttaaagaaggatttattag

SEQ ID NO: 36732 - DNA, 20 bp, Artificial Sequence
  Description of Artificial Sequence: Synthetic oligonucleotide
  Target: FXN; (+) strand; PAM type: YTN; PAM sequence: CTT
aaagaaggatttattagtgg

SEQ ID NO: 36733 - DNA, 20 bp, Artificial Sequence
  Description of Artificial Sequence: Synthetic oligonucleotide
  Target: FXN; (+) strand; PAM type: YTN; PAM sequence: TTA
aagaaggatttattagtggc

SEQ ID NO: 36734 - DNA, 20 bp, Artificial Sequence
  Description of Artificial Sequence: Synthetic oligonucleotide
  Target: FXN; (+) strand; PAM type: YTN; PAM sequence: TTT
attagtggctgggcatggtg

SEQ ID NO: 36735 - DNA, 20 bp, Artificial Sequence
  Description of Artificial Sequence: Synthetic oligonucleotide
  Target: FXN; (+) strand; PAM type: YTN; PAM sequence: TTA
ttagtggctgggcatggtgg

SEQ ID NO: 36736 - DNA, 20 bp, Artificial Sequence
  Description of Artificial Sequence: Synthetic oligonucleotide
  Target: FXN; (+) strand; PAM type: YTN; PAM sequence: TTA
gtggctgggcatggtggcgt

SEQ ID NO: 36737 - DNA, 20 bp, Artificial Sequence
  Description of Artificial Sequence: Synthetic oligonucleotide
  Target: FXN; (+) strand; PAM type: YTN; PAM sequence: CTG
ggcatggtggcgtgcacctg

SEQ ID NO: 36738 - DNA, 20 bp, Artificial Sequence
  Description of Artificial Sequence: Synthetic oligonucleotide
  Target: FXN; (+) strand; PAM type: YTN; PAM sequence: CTG
taatcccaggtactcaggag

SEQ ID NO: 36739 - DNA, 20 bp, Artificial Sequence
  Description of Artificial Sequence: Synthetic oligonucleotide
  Target: FXN; (+) strand; PAM type: YTN; PAM sequence: CTC
aggaggctgagacgggagaa

SEQ ID NO: 36740 - DNA, 20 bp, Artificial Sequence
  Description of Artificial Sequence: Synthetic oligonucleotide
  Target: FXN; (+) strand; PAM type: YTN; PAM sequence: CTG
agacgggagaattgcttgac

SEQ ID NO: 36741 - DNA, 20 bp, Artificial Sequence
  Description of Artificial Sequence: Synthetic oligonucleotide
  Target: FXN; (+) strand; PAM type: YTN; PAM sequence: TTG
cttgaccccaggcggaggag

SEQ ID NO: 36742 - DNA, 20 bp, Artificial Sequence
  Description of Artificial Sequence: Synthetic oligonucleotide
  Target: FXN; (+) strand; PAM type: YTN; PAM sequence: CTT
gaccccaggcggaggaggtt

SEQ ID NO: 36743 - DNA, 20 bp, Artificial Sequence
  Description of Artificial Sequence: Synthetic oligonucleotide
  Target: FXN; (+) strand; PAM type: YTN; PAM sequence: TTG
accccaggcggaggaggtta

SEQ ID NO: 36744 - DNA, 20 bp, Artificial Sequence
  Description of Artificial Sequence: Synthetic oligonucleotide
  Target: FXN; (+) strand; PAM type: YTN; PAM sequence: TTA
cagtgagtcgagatcgtacc

SEQ ID NO: 36745 - DNA, 20 bp, Artificial Sequence
  Description of Artificial Sequence: Synthetic oligonucleotide
  Target: FXN; (+) strand; PAM type: YTN; PAM sequence: CTG
agcgacagagcgagactccg

SEQ ID NO: 36746 - DNA, 20 bp, Artificial Sequence
  Description of Artificial Sequence: Synthetic oligonucleotide
  Target: FXN; (+) strand; PAM type: YTN; PAM sequence: CTC
cgtctcaaaaaaaaaaaaaa

SEQ ID NO: 36747 - DNA, 20 bp, Artificial Sequence
  Description of Artificial Sequence: Synthetic oligonucleotide
  Target: FXN; (+) strand; PAM type: YTN; PAM sequence: CTC
aaaaaaaaaaaaaaggaggg

SEQ ID NO: 36748 - DNA, 20 bp, Artificial Sequence
  Description of Artificial Sequence: Synthetic oligonucleotide
  Target: FXN; (+) strand; PAM type: YTN; PAM sequence: TTT
attaatgagaagtttgtatt

SEQ ID NO: 36749 - DNA, 20 bp, Artificial Sequence
  Description of Artificial Sequence: Synthetic oligonucleotide
  Target: FXN; (+) strand; PAM type: YTN; PAM sequence: TTA
ttaatgagaagtttgtatta

SEQ ID NO: 36750 - DNA, 20 bp, Artificial Sequence
  Description of Artificial Sequence: Synthetic oligonucleotide
  Target: FXN; (+) strand; PAM type: YTN; PAM sequence: TTA
atgagaagtttgtattaata

SEQ ID NO: 36751 - DNA, 20 bp, Artificial Sequence
  Description of Artificial Sequence: Synthetic oligonucleotide
  Target: FXN; (+) strand; PAM type: YTN; PAM sequence: TTT
gtattaatatgtagcaaagg

SEQ ID NO: 36752 - DNA, 20 bp, Artificial Sequence
  Description of Artificial Sequence: Synthetic oligonucleotide
  Target: FXN; (+) strand; PAM type: YTN; PAM sequence: TTG
tattaatatgtagcaaaggc

SEQ ID NO: 36753 - DNA, 20 bp, Artificial Sequence
  Description of Artificial Sequence: Synthetic oligonucleotide
  Target: FXN; (+) strand; PAM type: YTN; PAM sequence: TTA
atatgtagcaaaggcttttc

SEQ ID NO: 36754 - DNA, 20 bp, Artificial Sequence
  Description of Artificial Sequence: Synthetic oligonucleotide
  Target: FXN; (+) strand; PAM type: YTN; PAM sequence: CTT
ttccaatgggtgaataaaaa

SEQ ID NO: 36755 - DNA, 20 bp, Artificial Sequence
  Description of Artificial Sequence: Synthetic oligonucleotide
  Target: FXN; (+) strand; PAM type: YTN; PAM sequence: TTT
tccaatgggtgaataaaaac

SEQ ID NO: 36756 - DNA, 20 bp, Artificial Sequence
  Description of Artificial Sequence: Synthetic oligonucleotide
  Target: FXN; (+) strand; PAM type: YTN; PAM sequence: TTT
ccaatgggtgaataaaaaca

SEQ ID NO: 36757 - DNA, 20 bp, Artificial Sequence
  Description of Artificial Sequence: Synthetic oligonucleotide
  Target: FXN; (+) strand; PAM type: YTN; PAM sequence: TTC
caatgggtgaataaaaacac

SEQ ID NO: 36758 - DNA, 20 bp, Artificial Sequence
  Description of Artificial Sequence: Synthetic oligonucleotide
  Target: FXN; (+) strand; PAM type: YTN; PAM sequence: TTC
cattaagtcaagctgggagc

SEQ ID NO: 36759 - DNA, 20 bp, Artificial Sequence
  Description of Artificial Sequence: Synthetic oligonucleotide
  Target: FXN; (+) strand; PAM type: YTN; PAM sequence: TTA
agtcaagctgggagcagtgg

SEQ ID NO: 36760 - DNA, 20 bp, Artificial Sequence
  Description of Artificial Sequence: Synthetic oligonucleotide
  Target: FXN; (+) strand; PAM type: YTN; PAM sequence: CTG
ggagcagtggcatataccta

SEQ ID NO: 36761 - DNA, 20 bp, Artificial Sequence
  Description of Artificial Sequence: Synthetic oligonucleotide
  Target: FXN; (+) strand; PAM type: YTN; PAM sequence: CTA
tagtcccagctgcacaggag

SEQ ID NO: 36762 - DNA, 20 bp, Artificial Sequence
  Description of Artificial Sequence: Synthetic oligonucleotide
  Target: FXN; (+) strand; PAM type: YTN; PAM sequence: CTG
cacaggaggctgagacagga

SEQ ID NO: 36763 - DNA, 20 bp, Artificial Sequence
  Description of Artificial Sequence: Synthetic oligonucleotide
  Target: FXN; (+) strand; PAM type: YTN; PAM sequence: CTG
agacaggaggattgcttgaa

SEQ ID NO: 36764 - DNA, 20 bp, Artificial Sequence
  Description of Artificial Sequence: Synthetic oligonucleotide
  Target: FXN; (+) strand; PAM type: YTN; PAM sequence: TTG
cttgaagccaggaattggag

SEQ ID NO: 36765 - DNA, 20 bp, Artificial Sequence
  Description of Artificial Sequence: Synthetic oligonucleotide
  Target: FXN; (+) strand; PAM type: YTN; PAM sequence: CTT
gaagccaggaattggagatc

SEQ ID NO: 36766 - DNA, 20 bp, Artificial Sequence
  Description of Artificial Sequence: Synthetic oligonucleotide
  Target: FXN; (+) strand; PAM type: YTN; PAM sequence: TTG
aagccaggaattggagatca

SEQ ID NO: 36767 - DNA, 20 bp, Artificial Sequence
  Description of Artificial Sequence: Synthetic oligonucleotide
  Target: FXN; (+) strand; PAM type: YTN; PAM sequence: TTG
gagatcagcctgggcaacac

SEQ ID NO: 36768 - DNA, 20 bp, Artificial Sequence
  Description of Artificial Sequence: Synthetic oligonucleotide
  Target: FXN; (+) strand; PAM type: YTN; PAM sequence: CTG
ggcaacacagcaagatccta

SEQ ID NO: 36769 - DNA, 20 bp, Artificial Sequence
  Description of Artificial Sequence: Synthetic oligonucleotide
  Target: FXN; (+) strand; PAM type: YTN; PAM sequence: CTA
tctcttaaaaaaagaaaaaa

SEQ ID NO: 36770 - DNA, 20 bp, Artificial Sequence
  Description of Artificial Sequence: Synthetic oligonucleotide
  Target: FXN; (+) strand; PAM type: YTN; PAM sequence: CTC
ttaaaaaaagaaaaaaaaac

SEQ ID NO: 36771 - DNA, 20 bp, Artificial Sequence
  Description of Artificial Sequence: Synthetic oligonucleotide
  Target: FXN; (+) strand; PAM type: YTN; PAM sequence: CTT
aaaaaaagaaaaaaaaacct

SEQ ID NO: 36772 - DNA, 20 bp, Artificial Sequence
  Description of Artificial Sequence: Synthetic oligonucleotide
  Target: FXN; (+) strand; PAM type: YTN; PAM sequence: TTA
aaaaaagaaaaaaaaaccta

SEQ ID NO: 36773 - DNA, 20 bp, Artificial Sequence
  Description of Artificial Sequence: Synthetic oligonucleotide
  Target: FXN; (+) strand; PAM type: YTN; PAM sequence: CTA
ttaataataaaacagtataa

SEQ ID NO: 36774 - DNA, 20 bp, Artificial Sequence
  Description of Artificial Sequence: Synthetic oligonucleotide
  Target: FXN; (+) strand; PAM type: YTN; PAM sequence: TTA
ataataaaacagtataaaca

SEQ ID NO: 36775 - DNA, 20 bp, Artificial Sequence
  Description of Artificial Sequence: Synthetic oligonucleotide
  Target: FXN; (+) strand; PAM type: YTN; PAM sequence: CTA
aataggtaaaatattttttc

SEQ ID NO: 36776 - DNA, 20 bp, Artificial Sequence
  Description of Artificial Sequence: Synthetic oligonucleotide
  Target: FXN; (+) strand; PAM type: YTN; PAM sequence: TTT
tttctgaaataaaattattt

SEQ ID NO: 36777 - DNA, 20 bp, Artificial Sequence
  Description of Artificial Sequence: Synthetic oligonucleotide
  Target: FXN; (+) strand; PAM type: YTN; PAM sequence: TTT
ttctgaaataaaattatttt

SEQ ID NO: 36778 - DNA, 20 bp, Artificial Sequence
  Description of Artificial Sequence: Synthetic oligonucleotide
  Target: FXN; (+) strand; PAM type: YTN; PAM sequence: TTT
tctgaaataaaattattttt

SEQ ID NO: 36779 - DNA, 20 bp, Artificial Sequence
  Description of Artificial Sequence: Synthetic oligonucleotide
  Target: FXN; (+) strand; PAM type: YTN; PAM sequence: TTT
ctgaaataaaattatttttt

SEQ ID NO: 36780 - DNA, 20 bp, Artificial Sequence
  Description of Artificial Sequence: Synthetic oligonucleotide
  Target: FXN; (+) strand; PAM type: YTN; PAM sequence: TTC
tgaaataaaattattttttg

SEQ ID NO: 36781 - DNA, 20 bp, Artificial Sequence
  Description of Artificial Sequence: Synthetic oligonucleotide
  Target: FXN; (+) strand; PAM type: YTN; PAM sequence: CTG
aaataaaattattttttgag

SEQ ID NO: 36782 - DNA, 20 bp, Artificial Sequence
  Description of Artificial Sequence: Synthetic oligonucleotide
  Target: FXN; (+) strand; PAM type: YTN; PAM sequence: TTA
ttttttgagtctgatggaaa

SEQ ID NO: 36783 - DNA, 20 bp, Artificial Sequence
  Description of Artificial Sequence: Synthetic oligonucleotide
  Target: FXN; (+) strand; PAM type: YTN; PAM sequence: TTT
tttgagtctgatggaaatgt

SEQ ID NO: 36784 - DNA, 20 bp, Artificial Sequence
  Description of Artificial Sequence: Synthetic oligonucleotide
  Target: FXN; (+) strand; PAM type: YTN; PAM sequence: TTT
ttgagtctgatggaaatgtt

SEQ ID NO: 36785 - DNA, 20 bp, Artificial Sequence
  Description of Artificial Sequence: Synthetic oligonucleotide
  Target: FXN; (+) strand; PAM type: YTN; PAM sequence: TTT
tgagtctgatggaaatgttt

SEQ ID NO: 36786 - DNA, 20 bp, Artificial Sequence
  Description of Artificial Sequence: Synthetic oligonucleotide
  Target: FXN; (+) strand; PAM type: YTN; PAM sequence: TTT
gagtctgatggaaatgttta

SEQ ID NO: 36787 - DNA, 20 bp, Artificial Sequence
  Description of Artificial Sequence: Synthetic oligonucleotide
  Target: FXN; (+) strand; PAM type: YTN; PAM sequence: TTG
agtctgatggaaatgtttaa

SEQ ID NO: 36788 - DNA, 20 bp, Artificial Sequence
  Description of Artificial Sequence: Synthetic oligonucleotide
  Target: FXN; (+) strand; PAM type: YTN; PAM sequence: CTG
atggaaatgtttaagtgcag

SEQ ID NO: 36789 - DNA, 20 bp, Artificial Sequence
  Description of Artificial Sequence: Synthetic oligonucleotide
  Target: FXN; (+) strand; PAM type: YTN; PAM sequence: TTT
aagtgcagtaggccagtgcc

SEQ ID NO: 36790 - DNA, 20 bp, Artificial Sequence
  Description of Artificial Sequence: Synthetic oligonucleotide
  Target: FXN; (+) strand; PAM type: YTN; PAM sequence: TTA
agtgcagtaggccagtgcca

SEQ ID NO: 36791 - DNA, 20 bp, Artificial Sequence
  Description of Artificial Sequence: Synthetic oligonucleotide
  Target: FXN; (+) strand; PAM type: YTN; PAM sequence: TTT
gtatgtgtttgcatcttgct

SEQ ID NO: 36792 - DNA, 20 bp, Artificial Sequence
  Description of Artificial Sequence: Synthetic oligonucleotide
  Target: FXN; (+) strand; PAM type: YTN; PAM sequence: TTG
tatgtgtttgcatcttgctt

SEQ ID NO: 36793 - DNA, 20 bp, Artificial Sequence
  Description of Artificial Sequence: Synthetic oligonucleotide
  Target: FXN; (+) strand; PAM type: YTN; PAM sequence: TTT
gcatcttgcttctactgaaa

SEQ ID NO: 36794 - DNA, 20 bp, Artificial Sequence
  Description of Artificial Sequence: Synthetic oligonucleotide
  Target: FXN; (+) strand; PAM type: YTN; PAM sequence: TTG
catcttgcttctactgaaag

SEQ ID NO: 36795 - DNA, 20 bp, Artificial Sequence
  Description of Artificial Sequence: Synthetic oligonucleotide
  Target: FXN; (+) strand; PAM type: YTN; PAM sequence: CTT
gcttctactgaaagtttcag

SEQ ID NO: 36796 - DNA, 20 bp, Artificial Sequence
  Description of Artificial Sequence: Synthetic oligonucleotide
  Target: FXN; (+) strand; PAM type: YTN; PAM sequence: TTG
cttctactgaaagtttcagt

SEQ ID NO: 36797 - DNA, 20 bp, Artificial Sequence
  Description of Artificial Sequence: Synthetic oligonucleotide
  Target: FXN; (+) strand; PAM type: YTN; PAM sequence: CTT
ctactgaaagtttcagtgca

SEQ ID NO: 36798 - DNA, 20 bp, Artificial Sequence
  Description of Artificial Sequence: Synthetic oligonucleotide
  Target: FXN; (+) strand; PAM type: YTN; PAM sequence: TTC
tactgaaagtttcagtgcac

SEQ ID NO: 36799 - DNA, 20 bp, Artificial Sequence
  Description of Artificial Sequence: Synthetic oligonucleotide
  Target: FXN; (+) strand; PAM type: YTN; PAM sequence: CTA
ctgaaagtttcagtgcaccc

SEQ ID NO: 36800 - DNA, 20 bp, Artificial Sequence
  Description of Artificial Sequence: Synthetic oligonucleotide
  Target: FXN; (+) strand; PAM type: YTN; PAM sequence: CTG
aaagtttcagtgcaccccac

SEQ ID NO: 36801 - DNA, 20 bp, Artificial Sequence
  Description of Artificial Sequence: Synthetic oligonucleotide
  Target: FXN; (+) strand; PAM type: YTN; PAM sequence: TTT
cagtgcaccccacttactta

SEQ ID NO: 36802 - DNA, 20 bp, Artificial Sequence
  Description of Artificial Sequence: Synthetic oligonucleotide
  Target: FXN; (+) strand; PAM type: YTN; PAM sequence: TTC
agtgcaccccacttacttag

SEQ ID NO: 36803 - DNA, 20 bp, Artificial Sequence
  Description of Artificial Sequence: Synthetic oligonucleotide
  Target: FXN; (+) strand; PAM type: YTN; PAM sequence: CTT
acttagaactcggtgacatg

SEQ ID NO: 36804 - DNA, 20 bp, Artificial Sequence
  Description of Artificial Sequence: Synthetic oligonucleotide
  Target: FXN; (+) strand; PAM type: YTN; PAM sequence: TTA
cttagaactcggtgacatga

SEQ ID NO: 36805 - DNA, 20 bp, Artificial Sequence
  Description of Artificial Sequence: Synthetic oligonucleotide
  Target: FXN; (+) strand; PAM type: YTN; PAM sequence: CTT
agaactcggtgacatgatgt

SEQ ID NO: 36806 - DNA, 20 bp, Artificial Sequence
  Description of Artificial Sequence: Synthetic oligonucleotide
  Target: FXN; (+) strand; PAM type: YTN; PAM sequence: TTA
gaactcggtgacatgatgta

SEQ ID NO: 36807 - DNA, 20 bp, Artificial Sequence
  Description of Artificial Sequence: Synthetic oligonucleotide
  Target: FXN; (+) strand; PAM type: YTN; PAM sequence: CTC
ggtgacatgatgtactcctt

SEQ ID NO: 36808 - DNA, 20 bp, Artificial Sequence
  Description of Artificial Sequence: Synthetic oligonucleotide
  Target: FXN; (+) strand; PAM type: YTN; PAM sequence: CTC
ctttatctgggacacagcac

SEQ ID NO: 36809 - DNA, 20 bp, Artificial Sequence
  Description of Artificial Sequence: Synthetic oligonucleotide
  Target: FXN; (+) strand; PAM type: YTN; PAM sequence: CTT
tatctgggacacagcacaaa

SEQ ID NO: 36810 - DNA, 20 bp, Artificial Sequence
  Description of Artificial Sequence: Synthetic oligonucleotide
  Target: FXN; (+) strand; PAM type: YTN; PAM sequence: TTT
atctgggacacagcacaaaa

SEQ ID NO: 36811 - DNA, 20 bp, Artificial Sequence
  Description of Artificial Sequence: Synthetic oligonucleotide
  Target: FXN; (+) strand; PAM type: YTN; PAM sequence: TTA
tctgggacacagcacaaaag

SEQ ID NO: 36812 - DNA, 20 bp, Artificial Sequence
  Description of Artificial Sequence: Synthetic oligonucleotide
  Target: FXN; (+) strand; PAM type: YTN; PAM sequence: CTG
ggacacagcacaaaagaggt

SEQ ID NO: 36813 - DNA, 20 bp, Artificial Sequence
  Description of Artificial Sequence: Synthetic oligonucleotide
  Target: FXN; (+) strand; PAM type: YTN; PAM sequence: CTG
ctctgacatgaaagtggaag

SEQ ID NO: 36814 - DNA, 20 bp, Artificial Sequence
  Description of Artificial Sequence: Synthetic oligonucleotide
  Target: FXN; (+) strand; PAM type: YTN; PAM sequence: CTC
tgacatgaaagtggaagtta

SEQ ID NO: 36815 - DNA, 20 bp, Artificial Sequence
  Description of Artificial Sequence: Synthetic oligonucleotide
  Target: FXN; (+) strand; PAM type: YTN; PAM sequence: CTG
acatgaaagtggaagttaag

SEQ ID NO: 36816 - DNA, 20 bp, Artificial Sequence
  Description of Artificial Sequence: Synthetic oligonucleotide
  Target: FXN; (+) strand; PAM type: YTN; PAM sequence: TTA
aggaatctgggctcttatgg

SEQ ID NO: 36817 - DNA, 20 bp, Artificial Sequence
  Description of Artificial Sequence: Synthetic oligonucleotide
  Target: FXN; (+) strand; PAM type: YTN; PAM sequence: CTG
ggctcttatggggtccttgt

SEQ ID NO: 36818 - DNA, 20 bp, Artificial Sequence
  Description of Artificial Sequence: Synthetic oligonucleotide
  Target: FXN; (+) strand; PAM type: YTN; PAM sequence: CTC
ttatggggtccttgtgggcc

SEQ ID NO: 36819 - DNA, 20 bp, Artificial Sequence
  Description of Artificial Sequence: Synthetic oligonucleotide
  Target: FXN; (+) strand; PAM type: YTN; PAM sequence: CTT
atggggtccttgtgggccag

SEQ ID NO: 36820 - DNA, 20 bp, Artificial Sequence
  Description of Artificial Sequence: Synthetic oligonucleotide
  Target: FXN; (+) strand; PAM type: YTN; PAM sequence: TTA
tggggtccttgtgggccagc

SEQ ID NO: 36821 - DNA, 20 bp, Artificial Sequence
  Description of Artificial Sequence: Synthetic oligonucleotide
  Target: FXN; (+) strand; PAM type: YTN; PAM sequence: CTT
gtgggccagcccttcaggcc

SEQ ID NO: 36822 - DNA, 20 bp, Artificial Sequence
  Description of Artificial Sequence: Synthetic oligonucleotide
  Target: FXN; (+) strand; PAM type: YTN; PAM sequence: TTG
tgggccagcccttcaggcct

SEQ ID NO: 36823 - DNA, 20 bp, Artificial Sequence
  Description of Artificial Sequence: Synthetic oligonucleotide
  Target: FXN; (+) strand; PAM type: YTN; PAM sequence: CTT
caggcctattttactttcat

SEQ ID NO: 36824 - DNA, 20 bp, Artificial Sequence
  Description of Artificial Sequence: Synthetic oligonucleotide
  Target: FXN; (+) strand; PAM type: YTN; PAM sequence: TTC
aggcctattttactttcatt

SEQ ID NO: 36825 - DNA, 20 bp, Artificial Sequence
  Description of Artificial Sequence: Synthetic oligonucleotide
  Target: FXN; (+) strand; PAM type: YTN; PAM sequence: CTA
ttttactttcattttacata

SEQ ID NO: 36826 - DNA, 20 bp, Artificial Sequence
  Description of Artificial Sequence: Synthetic oligonucleotide
  Target: FXN; (+) strand; PAM type: YTN; PAM sequence: TTT
tactttcattttacatatag

SEQ ID NO: 36827 - DNA, 20 bp, Artificial Sequence
  Description of Artificial Sequence: Synthetic oligonucleotide
  Target: FXN; (+) strand; PAM type: YTN; PAM sequence: TTT
actttcattttacatatagc

SEQ ID NO: 36828 - DNA, 20 bp, Artificial Sequence
  Description of Artificial Sequence: Synthetic oligonucleotide
  Target: FXN; (+) strand; PAM type: YTN; PAM sequence: TTA
ctttcattttacatatagct

SEQ ID NO: 36829 - DNA, 20 bp, Artificial Sequence
  Description of Artificial Sequence: Synthetic oligonucleotide
  Target: FXN; (+) strand; PAM type: YTN; PAM sequence: CTT
tcattttacatatagctcta

SEQ ID NO: 36830 - DNA, 20 bp, Artificial Sequence
  Description of Artificial Sequence: Synthetic oligonucleotide
  Target: FXN; (+) strand; PAM type: YTN; PAM sequence: TTT
cattttacatatagctctaa

SEQ ID NO: 36831 - DNA, 20 bp, Artificial Sequence
  Description of Artificial Sequence: Synthetic oligonucleotide
  Target: FXN; (+) strand; PAM type: YTN; PAM sequence: TTC
attttacatatagctctaat

SEQ ID NO: 36832 - DNA, 20 bp, Artificial Sequence
  Description of Artificial Sequence: Synthetic oligonucleotide
  Target: FXN; (+) strand; PAM type: YTN; PAM sequence: TTT
tacatatagctctaattggt

SEQ ID NO: 36833 - DNA, 20 bp, Artificial Sequence
  Description of Artificial Sequence: Synthetic oligonucleotide
  Target: FXN; (+) strand; PAM type: YTN; PAM sequence: TTT
acatatagctctaattggtt

SEQ ID NO: 36834 - DNA, 20 bp, Artificial Sequence
  Description of Artificial Sequence: Synthetic oligonucleotide
  Target: FXN; (+) strand; PAM type: YTN; PAM sequence: TTA
catatagctctaattggttt

SEQ ID NO: 36835 - DNA, 20 bp, Artificial Sequence
  Description of Artificial Sequence: Synthetic oligonucleotide
  Target: FXN; (+) strand; PAM type: YTN; PAM sequence: CTC
taattggtttgattatctcg

SEQ ID NO: 36836 - DNA, 20 bp, Artificial Sequence
  Description of Artificial Sequence: Synthetic oligonucleotide
  Target: FXN; (+) strand; PAM type: YTN; PAM sequence: CTA
attggtttgattatctcgtt

SEQ ID NO: 36837 - DNA, 20 bp, Artificial Sequence
  Description of Artificial Sequence: Synthetic oligonucleotide
  Target: FXN; (+) strand; PAM type: YTN; PAM sequence: TTG
gtttgattatctcgttccca

SEQ ID NO: 36838 - DNA, 20 bp, Artificial Sequence
  Description of Artificial Sequence: Synthetic oligonucleotide
  Target: FXN; (+) strand; PAM type: YTN; PAM sequence: TTT
gattatctcgttcccaaggc

SEQ ID NO: 36839 - DNA, 20 bp, Artificial Sequence
  Description of Artificial Sequence: Synthetic oligonucleotide
  Target: FXN; (+) strand; PAM type: YTN; PAM sequence: TTG
attatctcgttcccaaggca

SEQ ID NO: 36840 - DNA, 20 bp, Artificial Sequence
  Description of Artificial Sequence: Synthetic oligonucleotide
  Target: FXN; (+) strand; PAM type: YTN; PAM sequence: TTA
tctcgttcccaaggcagtgg

SEQ ID NO: 36841 - DNA, 20 bp, Artificial Sequence
  Description of Artificial Sequence: Synthetic oligonucleotide
  Target: FXN; (+) strand; PAM type: YTN; PAM sequence: CTC
gttcccaaggcagtgggaga

SEQ ID NO: 36842 - DNA, 20 bp, Artificial Sequence
  Description of Artificial Sequence: Synthetic oligonucleotide
  Target: FXN; (+) strand; PAM type: YTN; PAM sequence: TTC
ccaaggcagtgggagatccc

SEQ ID NO: 36843 - DNA, 20 bp, Artificial Sequence
  Description of Artificial Sequence: Synthetic oligonucleotide
  Target: FXN; (+) strand; PAM type: YTN; PAM sequence: TTT
aaggaaagaaaaggggcctg

SEQ ID NO: 36844 - DNA, 20 bp, Artificial Sequence
  Description of Artificial Sequence: Synthetic oligonucleotide
  Target: FXN; (+) strand; PAM type: YTN; PAM sequence: TTA
aggaaagaaaaggggcctgg

SEQ ID NO: 36845 - DNA, 20 bp, Artificial Sequence
  Description of Artificial Sequence: Synthetic oligonucleotide
  Target: FXN; (+) strand; PAM type: YTN; PAM sequence: CTG
gcacagtggctcatgcctgt

SEQ ID NO: 36846 - DNA, 20 bp, Artificial Sequence
  Description of Artificial Sequence: Synthetic oligonucleotide
  Target: FXN; (+) strand; PAM type: YTN; PAM sequence: CTC
atgcctgtaatcccagcact

SEQ ID NO: 36847 - DNA, 20 bp, Artificial Sequence
  Description of Artificial Sequence: Synthetic oligonucleotide
  Target: FXN; (+) strand; PAM type: YTN; PAM sequence: CTG
taatcccagcactttgggag

SEQ ID NO: 36848 - DNA, 20 bp, Artificial Sequence
  Description of Artificial Sequence: Synthetic oligonucleotide
  Target: FXN; (+) strand; PAM type: YTN; PAM sequence: CTT
tgggaggctgaggcaagtgt

SEQ ID NO: 36849 - DNA, 20 bp, Artificial Sequence
  Description of Artificial Sequence: Synthetic oligonucleotide
  Target: FXN; (+) strand; PAM type: YTN; PAM sequence: TTT
gggaggctgaggcaagtgta

SEQ ID NO: 36850 - DNA, 20 bp, Artificial Sequence
  Description of Artificial Sequence: Synthetic oligonucleotide
  Target: FXN; (+) strand; PAM type: YTN; PAM sequence: TTG
ggaggctgaggcaagtgtat

SEQ ID NO: 36851 - DNA, 20 bp, Artificial Sequence
  Description of Artificial Sequence: Synthetic oligonucleotide
  Target: FXN; (+) strand; PAM type: YTN; PAM sequence: CTG
aggcaagtgtatcacctgag

SEQ ID NO: 36852 - DNA, 20 bp, Artificial Sequence
  Description of Artificial Sequence: Synthetic oligonucleotide
  Target: FXN; (+) strand; PAM type: YTN; PAM sequence: CTG
aggtcaggagttcaagacca

SEQ ID NO: 36853 - DNA, 20 bp, Artificial Sequence
  Description of Artificial Sequence: Synthetic oligonucleotide
  Target: FXN; (+) strand; PAM type: YTN; PAM sequence: TTC
aagaccagcctggccaacat

SEQ ID NO: 36854 - DNA, 20 bp, Artificial Sequence
  Description of Artificial Sequence: Synthetic oligonucleotide
  Target: FXN; (+) strand; PAM type: YTN; PAM sequence: CTG
gccaacatggcaaaatcccg

SEQ ID NO: 36855 - DNA, 20 bp, Artificial Sequence
  Description of Artificial Sequence: Synthetic oligonucleotide
  Target: FXN; (+) strand; PAM type: YTN; PAM sequence: CTC
tactaaaaatattaaaaaat

SEQ ID NO: 36856 - DNA, 20 bp, Artificial Sequence
  Description of Artificial Sequence: Synthetic oligonucleotide
  Target: FXN; (+) strand; PAM type: YTN; PAM sequence: CTA
ctaaaaatattaaaaaattg

SEQ ID NO: 36857 - DNA, 20 bp, Artificial Sequence
  Description of Artificial Sequence: Synthetic oligonucleotide
  Target: FXN; (+) strand; PAM type: YTN; PAM sequence: CTA
aaaatattaaaaaattggct

SEQ ID NO: 36858 - DNA, 20 bp, Artificial Sequence
  Description of Artificial Sequence: Synthetic oligonucleotide
  Target: FXN; (+) strand; PAM type: YTN; PAM sequence: TTA
aaaaattggctgggcgtggt

SEQ ID NO: 36859 - DNA, 20 bp, Artificial Sequence
  Description of Artificial Sequence: Synthetic oligonucleotide
  Target: FXN; (+) strand; PAM type: YTN; PAM sequence: TTG
gctgggcgtggtggttcgtg

SEQ ID NO: 36860 - DNA, 20 bp, Artificial Sequence
  Description of Artificial Sequence: Synthetic oligonucleotide
  Target: FXN; (+) strand; PAM type: YTN; PAM sequence: CTG
ggcgtggtggttcgtgccta

SEQ ID NO: 36861 - DNA, 20 bp, Artificial Sequence
  Description of Artificial Sequence: Synthetic oligonucleotide
  Target: FXN; (+) strand; PAM type: YTN; PAM sequence: TTC
gtgcctataatttcagctac

SEQ ID NO: 36862 - DNA, 20 bp, Artificial Sequence
  Description of Artificial Sequence: Synthetic oligonucleotide
  Target: FXN; (+) strand; PAM type: YTN; PAM sequence: CTA
taatttcagctactcaggag

SEQ ID NO: 36863 - DNA, 20 bp, Artificial Sequence
  Description of Artificial Sequence: Synthetic oligonucleotide
  Target: FXN; (+) strand; PAM type: YTN; PAM sequence: TTT
cagctactcaggaggctgag

SEQ ID NO: 36864 - DNA, 20 bp, Artificial Sequence
  Description of Artificial Sequence: Synthetic oligonucleotide
  Target: FXN; (+) strand; PAM type: YTN; PAM sequence: TTC
agctactcaggaggctgagg

SEQ ID NO: 36865 - DNA, 20 bp, Artificial Sequence
  Description of Artificial Sequence: Synthetic oligonucleotide
  Target: FXN; (+) strand; PAM type: YTN; PAM sequence: CTA
ctcaggaggctgaggcagga

SEQ ID NO: 36866 - DNA, 20 bp, Artificial Sequence
  Description of Artificial Sequence: Synthetic oligonucleotide
  Target: FXN; (+) strand; PAM type: YTN; PAM sequence: CTC
aggaggctgaggcaggagaa

SEQ ID NO: 36867 - DNA, 20 bp, Artificial Sequence
  Description of Artificial Sequence: Synthetic oligonucleotide
  Target: FXN; (+) strand; PAM type: YTN; PAM sequence: CTG
aggcaggagaatcgctgtaa

SEQ ID NO: 36868 - DNA, 20 bp, Artificial Sequence
  Description of Artificial Sequence: Synthetic oligonucleotide
  Target: FXN; (+) strand; PAM type: YTN; PAM sequence: CTG
taacctggggggtggaggtt

SEQ ID NO: 36869 - DNA, 20 bp, Artificial Sequence
  Description of Artificial Sequence: Synthetic oligonucleotide
  Target: FXN; (+) strand; PAM type: YTN; PAM sequence: CTG
gggggtggaggttgcagtga

SEQ ID NO: 36870 - DNA, 20 bp, Artificial Sequence
  Description of Artificial Sequence: Synthetic oligonucleotide
  Target: FXN; (+) strand; PAM type: YTN; PAM sequence: TTG
cagtgagacgagatcatgcc

SEQ ID NO: 36871 - DNA, 20 bp, Artificial Sequence
  Description of Artificial Sequence: Synthetic oligonucleotide
  Target: FXN; (+) strand; PAM type: YTN; PAM sequence: CTT
cactccagcctggccaacag

SEQ ID NO: 36872 - DNA, 20 bp, Artificial Sequence
  Description of Artificial Sequence: Synthetic oligonucleotide
  Target: FXN; (+) strand; PAM type: YTN; PAM sequence: TTC
actccagcctggccaacaga

SEQ ID NO: 36873 - DNA, 20 bp, Artificial Sequence
  Description of Artificial Sequence: Synthetic oligonucleotide
  Target: FXN; (+) strand; PAM type: YTN; PAM sequence: CTC
cagcctggccaacagagcca

SEQ ID NO: 36874 - DNA, 20 bp, Artificial Sequence
  Description of Artificial Sequence: Synthetic oligonucleotide
  Target: FXN; (+) strand; PAM type: YTN; PAM sequence: CTG
gccaacagagccatactccg

SEQ ID NO: 36875 - DNA, 20 bp, Artificial Sequence
  Description of Artificial Sequence: Synthetic oligonucleotide
  Target: FXN; (+) strand; PAM type: YTN; PAM sequence: CTC
cgtctcaaataaataaataa

SEQ ID NO: 36876 - DNA, 20 bp, Artificial Sequence
  Description of Artificial Sequence: Synthetic oligonucleotide
  Target: FXN; (+) strand; PAM type: YTN; PAM sequence: CTC
aaataaataaataaataaat

SEQ ID NO: 36877 - DNA, 20 bp, Artificial Sequence
  Description of Artificial Sequence: Synthetic oligonucleotide
  Target: FXN; (+) strand; PAM type: YTN; PAM sequence: CTT
caaacacatgaacagcagcc

SEQ ID NO: 36878 - DNA, 20 bp, Artificial Sequence
  Description of Artificial Sequence: Synthetic oligonucleotide
  Target: FXN; (+) strand; PAM type: YTN; PAM sequence: TTC
aaacacatgaacagcagcca

SEQ ID NO: 36879 - DNA, 20 bp, Artificial Sequence
  Description of Artificial Sequence: Synthetic oligonucleotide
  Target: FXN; (+) strand; PAM type: YTN; PAM sequence: TTC
tgtcaagcaaactggaaaag

SEQ ID NO: 36880 - DNA, 20 bp, Artificial Sequence
  Description of Artificial Sequence: Synthetic oligonucleotide
  Target: FXN; (+) strand; PAM type: YTN; PAM sequence: CTG
tcaagcaaactggaaaagta

SEQ ID NO: 36881 - DNA, 20 bp, Artificial Sequence
  Description of Artificial Sequence: Synthetic oligonucleotide
  Target: FXN; (+) strand; PAM type: YTN; PAM sequence: CTG
gaaaagtaccactgtgtgta

SEQ ID NO: 36882 - DNA, 20 bp, Artificial Sequence
  Description of Artificial Sequence: Synthetic oligonucleotide
  Target: FXN; (+) strand; PAM type: YTN; PAM sequence: CTG
tgtgtaccaatagcctcccc

SEQ ID NO: 36883 - DNA, 20 bp, Artificial Sequence
  Description of Artificial Sequence: Synthetic oligonucleotide
  Target: FXN; (+) strand; PAM type: YTN; PAM sequence: CTC
cccaccacagaccctgggag

SEQ ID NO: 36884 - DNA, 20 bp, Artificial Sequence
  Description of Artificial Sequence: Synthetic oligonucleotide
  Target: FXN; (+) strand; PAM type: YTN; PAM sequence: CTG
ggagcatcgcctcatttatg

SEQ ID NO: 36885 - DNA, 20 bp, Artificial Sequence
  Description of Artificial Sequence: Synthetic oligonucleotide
  Target: FXN; (+) strand; PAM type: YTN; PAM sequence: CTC
atttatggtgtggtccagtc

SEQ ID NO: 36886 - DNA, 20 bp, Artificial Sequence
  Description of Artificial Sequence: Synthetic oligonucleotide
  Target: FXN; (+) strand; PAM type: YTN; PAM sequence: TTT
atggtgtggtccagtcatcc

SEQ ID NO: 36887 - DNA, 20 bp, Artificial Sequence
  Description of Artificial Sequence: Synthetic oligonucleotide
  Target: FXN; (+) strand; PAM type: YTN; PAM sequence: TTA
tggtgtggtccagtcatcca

SEQ ID NO: 36888 - DNA, 20 bp, Artificial Sequence
  Description of Artificial Sequence: Synthetic oligonucleotide
  Target: FXN; (+) strand; PAM type: YTN; PAM sequence: TTT
ccaggaaaaggttattaaat

SEQ ID NO: 36889 - DNA, 20 bp, Artificial Sequence
  Description of Artificial Sequence: Synthetic oligonucleotide
  Target: FXN; (+) strand; PAM type: YTN; PAM sequence: TTC
caggaaaaggttattaaata

SEQ ID NO: 36890 - DNA, 20 bp, Artificial Sequence
  Description of Artificial Sequence: Synthetic oligonucleotide
  Target: FXN; (+) strand; PAM type: YTN; PAM sequence: TTA
ttaaatattcactgtaacat

SEQ ID NO: 36891 - DNA, 20 bp, Artificial Sequence
  Description of Artificial Sequence: Synthetic oligonucleotide
  Target: FXN; (+) strand; PAM type: YTN; PAM sequence: TTA
aatattcactgtaacatact

SEQ ID NO: 36892 - DNA, 20 bp, Artificial Sequence
  Description of Artificial Sequence: Synthetic oligonucleotide
  Target: FXN; (+) strand; PAM type: YTN; PAM sequence: TTC
actgtaacatactggaggag

SEQ ID NO: 36893 - DNA, 20 bp, Artificial Sequence
  Description of Artificial Sequence: Synthetic oligonucleotide
  Target: FXN; (+) strand; PAM type: YTN; PAM sequence: CTG
taacatactggaggaggtga

SEQ ID NO: 36894 - DNA, 20 bp, Artificial Sequence
  Description of Artificial Sequence: Synthetic oligonucleotide
  Target: FXN; (+) strand; PAM type: YTN; PAM sequence: CTG
gaggaggtgaggaattgcat

SEQ ID NO: 36895 - DNA, 20 bp, Artificial Sequence
  Description of Artificial Sequence: Synthetic oligonucleotide
  Target: FXN; (+) strand; PAM type: YTN; PAM sequence: TTG
cataatacaatcttagaaaa

SEQ ID NO: 36896 - DNA, 20 bp, Artificial Sequence
  Description of Artificial Sequence: Synthetic oligonucleotide
  Target: FXN; (+) strand; PAM type: YTN; PAM sequence: CTT
agaaaacttttttttcccct

SEQ ID NO: 36897 - DNA, 20 bp, Artificial Sequence
  Description of Artificial Sequence: Synthetic oligonucleotide
  Target: FXN; (+) strand; PAM type: YTN; PAM sequence: TTA
gaaaacttttttttcccctt

SEQ ID NO: 36898 - DNA, 20 bp, Artificial Sequence
  Description of Artificial Sequence: Synthetic oligonucleotide
  Target: FXN; (+) strand; PAM type: YTN; PAM sequence: CTT
ttttttcccctttctatttt

SEQ ID NO: 36899 - DNA, 20 bp, Artificial Sequence
  Description of Artificial Sequence: Synthetic oligonucleotide
  Target: FXN; (+) strand; PAM type: YTN; PAM sequence: TTT
tttttcccctttctattttt

SEQ ID NO: 36900 - DNA, 20 bp, Artificial Sequence
  Description of Artificial Sequence: Synthetic oligonucleotide
  Target: FXN; (+) strand; PAM type: YTN; PAM sequence: TTT
ttttcccctttctatttttt

SEQ ID NO: 36901 - DNA, 20 bp, Artificial Sequence
  Description of Artificial Sequence: Synthetic oligonucleotide
  Target: FXN; (+) strand; PAM type: YTN; PAM sequence: TTT
tttcccctttctattttttg

SEQ ID NO: 36902 - DNA, 20 bp, Artificial Sequence
  Description of Artificial Sequence: Synthetic oligonucleotide
  Target: FXN; (+) strand; PAM type: YTN; PAM sequence: TTT
ttcccctttctattttttga

SEQ ID NO: 36903 - DNA, 20 bp, Artificial Sequence
  Description of Artificial Sequence: Synthetic oligonucleotide
  Target: FXN; (+) strand; PAM type: YTN; PAM sequence: TTT
tcccctttctattttttgag

SEQ ID NO: 36904 - DNA, 20 bp, Artificial Sequence
  Description of Artificial Sequence: Synthetic oligonucleotide
  Target: FXN; (+) strand; PAM type: YTN; PAM sequence: TTT
cccctttctattttttgaga

SEQ ID NO: 36905 - DNA, 20 bp, Artificial Sequence
  Description of Artificial Sequence: Synthetic oligonucleotide
  Target: FXN; (+) strand; PAM type: YTN; PAM sequence: TTC
ccctttctattttttgagac

SEQ ID NO: 36906 - DNA, 20 bp, Artificial Sequence
  Description of Artificial Sequence: Synthetic oligonucleotide
  Target: FXN; (+) strand; PAM type: YTN; PAM sequence: CTT
tctattttttgagacaggat

SEQ ID NO: 36907 - DNA, 20 bp, Artificial Sequence
  Description of Artificial Sequence: Synthetic oligonucleotide
  Target: FXN; (+) strand; PAM type: YTN; PAM sequence: TTT
ctattttttgagacaggatc

SEQ ID NO: 36908 - DNA, 20 bp, Artificial Sequence
  Description of Artificial Sequence: Synthetic oligonucleotide
  Target: FXN; (+) strand; PAM type: YTN; PAM sequence: TTC
tattttttgagacaggatct

SEQ ID NO: 36909 - DNA, 20 bp, Artificial Sequence
  Description of Artificial Sequence: Synthetic oligonucleotide
  Target: FXN; (+) strand; PAM type: YTN; PAM sequence: CTA
ttttttgagacaggatctca

SEQ ID NO: 36910 - DNA, 20 bp, Artificial Sequence
  Description of Artificial Sequence: Synthetic oligonucleotide
  Target: FXN; (+) strand; PAM type: YTN; PAM sequence: TTT
tttgagacaggatctcactt

SEQ ID NO: 36911 - DNA, 20 bp, Artificial Sequence
  Description of Artificial Sequence: Synthetic oligonucleotide
  Target: FXN; (+) strand; PAM type: YTN; PAM sequence: TTT
ttgagacaggatctcacttt

SEQ ID NO: 36912 - DNA, 20 bp, Artificial Sequence
  Description of Artificial Sequence: Synthetic oligonucleotide
  Target: FXN; (+) strand; PAM type: YTN; PAM sequence: TTT
tgagacaggatctcactttg

SEQ ID NO: 36913 - DNA, 20 bp, Artificial Sequence
  Description of Artificial Sequence: Synthetic oligonucleotide
  Target: FXN; (+) strand; PAM type: YTN; PAM sequence: TTT
gagacaggatctcactttgg

SEQ ID NO: 36914 - DNA, 20 bp, Artificial Sequence
  Description of Artificial Sequence: Synthetic oligonucleotide
  Target: FXN; (+) strand; PAM type: YTN; PAM sequence: TTG
agacaggatctcactttggc

SEQ ID NO: 36915 - DNA, 20 bp, Artificial Sequence
  Description of Artificial Sequence: Synthetic oligonucleotide
  Target: FXN; (+) strand; PAM type: YTN; PAM sequence: CTC
actttggcactcaggctgga

SEQ ID NO: 36916 - DNA, 20 bp, Artificial Sequence
  Description of Artificial Sequence: Synthetic oligonucleotide
  Target: FXN; (+) strand; PAM type: YTN; PAM sequence: CTT
tggcactcaggctggaggac

SEQ ID NO: 36917 - DNA, 20 bp, Artificial Sequence
  Description of Artificial Sequence: Synthetic oligonucleotide
  Target: FXN; (+) strand; PAM type: YTN; PAM sequence: TTT
ggcactcaggctggaggaca

SEQ ID NO: 36918 - DNA, 20 bp, Artificial Sequence
  Description of Artificial Sequence: Synthetic oligonucleotide
  Target: FXN; (+) strand; PAM type: YTN; PAM sequence: TTG
gcactcaggctggaggacag

SEQ ID NO: 36919 - DNA, 20 bp, Artificial Sequence
  Description of Artificial Sequence: Synthetic oligonucleotide
  Target: FXN; (+) strand; PAM type: YTN; PAM sequence: CTC
aggctggaggacagtggtac

SEQ ID NO: 36920 - DNA, 20 bp, Artificial Sequence
  Description of Artificial Sequence: Synthetic oligonucleotide
  Target: FXN; (+) strand; PAM type: YTN; PAM sequence: CTG
gaggacagtggtacaatcaa

SEQ ID NO: 36921 - DNA, 20 bp, Artificial Sequence
  Description of Artificial Sequence: Synthetic oligonucleotide
  Target: FXN; (+) strand; PAM type: YTN; PAM sequence: CTC
atggcagcctcgacctccct

SEQ ID NO: 36922 - DNA, 20 bp, Artificial Sequence
  Description of Artificial Sequence: Synthetic oligonucleotide
  Target: FXN; (+) strand; PAM type: YTN; PAM sequence: CTC
gacctccctgggcttgggca

SEQ ID NO: 36923 - DNA, 20 bp, Artificial Sequence
  Description of Artificial Sequence: Synthetic oligonucleotide
  Target: FXN; (+) strand; PAM type: YTN; PAM sequence: CTC
cctgggcttgggcaatcctc

SEQ ID NO: 36924 - DNA, 20 bp, Artificial Sequence
  Description of Artificial Sequence: Synthetic oligonucleotide
  Target: FXN; (+) strand; PAM type: YTN; PAM sequence: CTG
ggcttgggcaatcctcccac

SEQ ID NO: 36925 - DNA, 20 bp, Artificial Sequence
  Description of Artificial Sequence: Synthetic oligonucleotide
  Target: FXN; (+) strand; PAM type: YTN; PAM sequence: CTT
gggcaatcctcccacaggtg

SEQ ID NO: 36926 - DNA, 20 bp, Artificial Sequence
  Description of Artificial Sequence: Synthetic oligonucleotide
  Target: FXN; (+) strand; PAM type: YTN; PAM sequence: TTG
ggcaatcctcccacaggtgt

SEQ ID NO: 36927 - DNA, 20 bp, Artificial Sequence
  Description of Artificial Sequence: Synthetic oligonucleotide
  Target: FXN; (+) strand; PAM type: YTN; PAM sequence: CTC
ccacaggtgtgcacctccat

SEQ ID NO: 36928 - DNA, 20 bp, Artificial Sequence
  Description of Artificial Sequence: Synthetic oligonucleotide
  Target: FXN; (+) strand; PAM type: YTN; PAM sequence: CTC
catagctggctaatttgtgt

SEQ ID NO: 36929 - DNA, 20 bp, Artificial Sequence
  Description of Artificial Sequence: Synthetic oligonucleotide
  Target: FXN; (+) strand; PAM type: YTN; PAM sequence: CTG
gctaatttgtgtattttttg

SEQ ID NO: 36930 - DNA, 20 bp, Artificial Sequence
  Description of Artificial Sequence: Synthetic oligonucleotide
  Target: FXN; (+) strand; PAM type: YTN; PAM sequence: CTA
atttgtgtattttttgtaga

SEQ ID NO: 36931 - DNA, 20 bp, Artificial Sequence
  Description of Artificial Sequence: Synthetic oligonucleotide
  Target: FXN; (+) strand; PAM type: YTN; PAM sequence: TTT
gtgtattttttgtagagatg

SEQ ID NO: 36932 - DNA, 20 bp, Artificial Sequence
  Description of Artificial Sequence: Synthetic oligonucleotide
  Target: FXN; (+) strand; PAM type: YTN; PAM sequence: TTG
tgtattttttgtagagatgg

SEQ ID NO: 36933 - DNA, 20 bp, Artificial Sequence
  Description of Artificial Sequence: Synthetic oligonucleotide
  Target: FXN; (+) strand; PAM type: YTN; PAM sequence: TTT
tttgtagagatggggtttca

SEQ ID NO: 36934 - DNA, 20 bp, Artificial Sequence
  Description of Artificial Sequence: Synthetic oligonucleotide
  Target: FXN; (+) strand; PAM type: YTN; PAM sequence: TTT
ttgtagagatggggtttcac

SEQ ID NO: 36935 - DNA, 20 bp, Artificial Sequence
  Description of Artificial Sequence: Synthetic oligonucleotide
  Target: FXN; (+) strand; PAM type: YTN; PAM sequence: TTT
tgtagagatggggtttcacc

SEQ ID NO: 36936 - DNA, 20 bp, Artificial Sequence
  Description of Artificial Sequence: Synthetic oligonucleotide
  Target: FXN; (+) strand; PAM type: YTN; PAM sequence: TTT
gtagagatggggtttcacca

SEQ ID NO: 36937 - DNA, 20 bp, Artificial Sequence
  Description of Artificial Sequence: Synthetic oligonucleotide
  Target: FXN; (+) strand; PAM type: YTN; PAM sequence: TTG
tagagatggggtttcaccat

SEQ ID NO: 36938 - DNA, 20 bp, Artificial Sequence
  Description of Artificial Sequence: Synthetic oligonucleotide
  Target: FXN; (+) strand; PAM type: YTN; PAM sequence: TTT
caccatgttgcccaggctgg

SEQ ID NO: 36939 - DNA, 20 bp, Artificial Sequence
  Description of Artificial Sequence: Synthetic oligonucleotide
  Target: FXN; (+) strand; PAM type: YTN; PAM sequence: TTC
accatgttgcccaggctggt

SEQ ID NO: 36940 - DNA, 20 bp, Artificial Sequence
  Description of Artificial Sequence: Synthetic oligonucleotide
  Target: FXN; (+) strand; PAM type: YTN; PAM sequence: TTG
cccaggctggtctctaacac

SEQ ID NO: 36941 - DNA, 20 bp, Artificial Sequence
  Description of Artificial Sequence: Synthetic oligonucleotide
  Target: FXN; (+) strand; PAM type: YTN; PAM sequence: CTG
gtctctaacacttaggctca

SEQ ID NO: 36942 - DNA, 20 bp, Artificial Sequence
  Description of Artificial Sequence: Synthetic oligonucleotide
  Target: FXN; (+) strand; PAM type: YTN; PAM sequence: CTC
taacacttaggctcaagtga

SEQ ID NO: 36943 - DNA, 20 bp, Artificial Sequence
  Description of Artificial Sequence: Synthetic oligonucleotide
  Target: FXN; (+) strand; PAM type: YTN; PAM sequence: CTA
acacttaggctcaagtgatc

SEQ ID NO: 36944 - DNA, 20 bp, Artificial Sequence
  Description of Artificial Sequence: Synthetic oligonucleotide
  Target: FXN; (+) strand; PAM type: YTN; PAM sequence: CTT
aggctcaagtgatccacctg

SEQ ID NO: 36945 - DNA, 20 bp, Artificial Sequence
  Description of Artificial Sequence: Synthetic oligonucleotide
  Target: FXN; (+) strand; PAM type: YTN; PAM sequence: TTA
ggctcaagtgatccacctgc

SEQ ID NO: 36946 - DNA, 20 bp, Artificial Sequence
  Description of Artificial Sequence: Synthetic oligonucleotide
  Target: FXN; (+) strand; PAM type: YTN; PAM sequence: CTC
aagtgatccacctgcctcgt

SEQ ID NO: 36947 - DNA, 20 bp, Artificial Sequence
  Description of Artificial Sequence: Synthetic oligonucleotide
  Target: FXN; (+) strand; PAM type: YTN; PAM sequence: CTG
cctcgtcctcccaagatgct

SEQ ID NO: 36948 - DNA, 20 bp, Artificial Sequence
  Description of Artificial Sequence: Synthetic oligonucleotide
  Target: FXN; (+) strand; PAM type: YTN; PAM sequence: CTC
gtcctcccaagatgctggga

SEQ ID NO: 36949 - DNA, 20 bp, Artificial Sequence
  Description of Artificial Sequence: Synthetic oligonucleotide
  Target: FXN; (+) strand; PAM type: YTN; PAM sequence: CTC
ccaagatgctgggattacag

SEQ ID NO: 36950 - DNA, 20 bp, Artificial Sequence
  Description of Artificial Sequence: Synthetic oligonucleotide
  Target: FXN; (+) strand; PAM type: YTN; PAM sequence: CTG
ggattacaggtgtgtgccac

SEQ ID NO: 36951 - DNA, 20 bp, Artificial Sequence
  Description of Artificial Sequence: Synthetic oligonucleotide
  Target: FXN; (+) strand; PAM type: YTN; PAM sequence: TTA
caggtgtgtgccacaggtgt

SEQ ID NO: 36952 - DNA, 20 bp, Artificial Sequence
  Description of Artificial Sequence: Synthetic oligonucleotide
  Target: FXN; (+) strand; PAM type: YTN; PAM sequence: TTC
atcagaaagctttttctatt

SEQ ID NO: 36953 - DNA, 20 bp, Artificial Sequence
  Description of Artificial Sequence: Synthetic oligonucleotide
  Target: FXN; (+) strand; PAM type: YTN; PAM sequence: CTT
tttctattatttttaccttc

SEQ ID NO: 36954 - DNA, 20 bp, Artificial Sequence
  Description of Artificial Sequence: Synthetic oligonucleotide
  Target: FXN; (+) strand; PAM type: YTN; PAM sequence: TTT
ttctattatttttaccttct

SEQ ID NO: 36955 - DNA, 20 bp, Artificial Sequence
  Description of Artificial Sequence: Synthetic oligonucleotide
  Target: FXN; (+) strand; PAM type: YTN; PAM sequence: TTT
tctattatttttaccttctt

SEQ ID NO: 36956 - DNA, 20 bp, Artificial Sequence
  Description of Artificial Sequence: Synthetic oligonucleotide
  Target: FXN; (+) strand; PAM type: YTN; PAM sequence: TTT
ctattatttttaccttcttg

SEQ ID NO: 36957 - DNA, 20 bp, Artificial Sequence
  Description of Artificial Sequence: Synthetic oligonucleotide
  Target: FXN; (+) strand; PAM type: YTN; PAM sequence: TTC
tattatttttaccttcttga

SEQ ID NO: 36958 - DNA, 20 bp, Artificial Sequence
  Description of Artificial Sequence: Synthetic oligonucleotide
  Target: FXN; (+) strand; PAM type: YTN; PAM sequence: CTA
ttatttttaccttcttgagt

SEQ ID NO: 36959 - DNA, 20 bp, Artificial Sequence
  Description of Artificial Sequence: Synthetic oligonucleotide
  Target: FXN; (+) strand; PAM type: YTN; PAM sequence: TTA
tttttaccttcttgagtggg

SEQ ID NO: 36960 - DNA, 20 bp, Artificial Sequence
  Description of Artificial Sequence: Synthetic oligonucleotide
  Target: FXN; (+) strand; PAM type: YTN; PAM sequence: TTT
ttaccttcttgagtgggtag

SEQ ID NO: 36961 - DNA, 20 bp, Artificial Sequence
  Description of Artificial Sequence: Synthetic oligonucleotide
  Target: FXN; (+) strand; PAM type: YTN; PAM sequence: TTT
taccttcttgagtgggtaga

SEQ ID NO: 36962 - DNA, 20 bp, Artificial Sequence
  Description of Artificial Sequence: Synthetic oligonucleotide
  Target: FXN; (+) strand; PAM type: YTN; PAM sequence: TTT
accttcttgagtgggtagaa

SEQ ID NO: 36963 - DNA, 20 bp, Artificial Sequence
  Description of Artificial Sequence: Synthetic oligonucleotide
  Target: FXN; (+) strand; PAM type: YTN; PAM sequence: TTA
ccttcttgagtgggtagaac

SEQ ID NO: 36964 - DNA, 20 bp, Artificial Sequence
  Description of Artificial Sequence: Synthetic oligonucleotide
  Target: FXN; (+) strand; PAM type: YTN; PAM sequence: CTT
cttgagtgggtagaacctca

SEQ ID NO: 36965 - DNA, 20 bp, Artificial Sequence
  Description of Artificial Sequence: Synthetic oligonucleotide
  Target: FXN; (+) strand; PAM type: YTN; PAM sequence: TTC
ttgagtgggtagaacctcag

SEQ ID NO: 36966 - DNA, 20 bp, Artificial Sequence
  Description of Artificial Sequence: Synthetic oligonucleotide
  Target: FXN; (+) strand; PAM type: YTN; PAM sequence: CTT
gagtgggtagaacctcagcc

SEQ ID NO: 36967 - DNA, 20 bp, Artificial Sequence
  Description of Artificial Sequence: Synthetic oligonucleotide
  Target: FXN; (+) strand; PAM type: YTN; PAM sequence: TTG
agtgggtagaacctcagcca

SEQ ID NO: 36968 - DNA, 20 bp, Artificial Sequence
  Description of Artificial Sequence: Synthetic oligonucleotide
  Target: FXN; (+) strand; PAM type: YTN; PAM sequence: CTC
agccacatagaaaataaaat

SEQ ID NO: 36969 - DNA, 20 bp, Artificial Sequence
  Description of Artificial Sequence: Synthetic oligonucleotide
  Target: FXN; (+) strand; PAM type: YTN; PAM sequence: TTC
tggcatgacttatttagctc

SEQ ID NO: 36970 - DNA, 20 bp, Artificial Sequence
  Description of Artificial Sequence: Synthetic oligonucleotide
  Target: FXN; (+) strand; PAM type: YTN; PAM sequence: CTG
gcatgacttatttagctctc

SEQ ID NO: 36971 - DNA, 20 bp, Artificial Sequence
  Description of Artificial Sequence: Synthetic oligonucleotide
  Target: FXN; (+) strand; PAM type: YTN; PAM sequence: CTT
atttagctctctggaattac

SEQ ID NO: 36972 - DNA, 20 bp, Artificial Sequence
  Description of Artificial Sequence: Synthetic oligonucleotide
  Target: FXN; (+) strand; PAM type: YTN; PAM sequence: TTA
tttagctctctggaattaca

SEQ ID NO: 36973 - DNA, 20 bp, Artificial Sequence
  Description of Artificial Sequence: Synthetic oligonucleotide
  Target: FXN; (+) strand; PAM type: YTN; PAM sequence: TTT
agctctctggaattacaaag

SEQ ID NO: 36974 - DNA, 20 bp, Artificial Sequence
  Description of Artificial Sequence: Synthetic oligonucleotide
  Target: FXN; (+) strand; PAM type: YTN; PAM sequence: TTA
gctctctggaattacaaaga

SEQ ID NO: 36975 - DNA, 20 bp, Artificial Sequence
  Description of Artificial Sequence: Synthetic oligonucleotide
  Target: FXN; (+) strand; PAM type: YTN; PAM sequence: CTC
tctggaattacaaagaagga

SEQ ID NO: 36976 - DNA, 20 bp, Artificial Sequence
  Description of Artificial Sequence: Synthetic oligonucleotide
  Target: FXN; (+) strand; PAM type: YTN; PAM sequence: CTC
tggaattacaaagaaggaat

SEQ ID NO: 36977 - DNA, 20 bp, Artificial Sequence
  Description of Artificial Sequence: Synthetic oligonucleotide
  Target: FXN; (+) strand; PAM type: YTN; PAM sequence: CTG
gaattacaaagaaggaatga

SEQ ID NO: 36978 - DNA, 20 bp, Artificial Sequence
  Description of Artificial Sequence: Synthetic oligonucleotide
  Target: FXN; (+) strand; PAM type: YTN; PAM sequence: TTA
caaagaaggaatgaggtgtg

SEQ ID NO: 36979 - DNA, 20 bp, Artificial Sequence
  Description of Artificial Sequence: Synthetic oligonucleotide
  Target: FXN; (+) strand; PAM type: YTN; PAM sequence: CTG
ggtttttgaatcacaaattt

SEQ ID NO: 36980 - DNA, 20 bp, Artificial Sequence
  Description of Artificial Sequence: Synthetic oligonucleotide
  Target: FXN; (+) strand; PAM type: YTN; PAM sequence: TTT
ttgaatcacaaatttagaat

SEQ ID NO: 36981 - DNA, 20 bp, Artificial Sequence
  Description of Artificial Sequence: Synthetic oligonucleotide
  Target: FXN; (+) strand; PAM type: YTN; PAM sequence: TTT
tgaatcacaaatttagaatt

SEQ ID NO: 36982 - DNA, 20 bp, Artificial Sequence
  Description of Artificial Sequence: Synthetic oligonucleotide
  Target: FXN; (+) strand; PAM type: YTN; PAM sequence: TTT
gaatcacaaatttagaattt

SEQ ID NO: 36983 - DNA, 20 bp, Artificial Sequence
  Description of Artificial Sequence: Synthetic oligonucleotide
  Target: FXN; (+) strand; PAM type: YTN; PAM sequence: TTG
aatcacaaatttagaattta

SEQ ID NO: 36984 - DNA, 20 bp, Artificial Sequence
  Description of Artificial Sequence: Synthetic oligonucleotide
  Target: FXN; (+) strand; PAM type: YTN; PAM sequence: TTT
agaatttaatcgaaactctg

SEQ ID NO: 36985 - DNA, 20 bp, Artificial Sequence
  Description of Artificial Sequence: Synthetic oligonucleotide
  Target: FXN; (+) strand; PAM type: YTN; PAM sequence: TTA
gaatttaatcgaaactctgc

SEQ ID NO: 36986 - DNA, 20 bp, Artificial Sequence
  Description of Artificial Sequence: Synthetic oligonucleotide
  Target: FXN; (+) strand; PAM type: YTN; PAM sequence: TTT
aatcgaaactctgcctctta

SEQ ID NO: 36987 - DNA, 20 bp, Artificial Sequence
  Description of Artificial Sequence: Synthetic oligonucleotide
  Target: FXN; (+) strand; PAM type: YTN; PAM sequence: TTA
atcgaaactctgcctcttac

SEQ ID NO: 36988 - DNA, 20 bp, Artificial Sequence
  Description of Artificial Sequence: Synthetic oligonucleotide
  Target: FXN; (+) strand; PAM type: YTN; PAM sequence: CTC
tgcctcttacttgtttgtag

SEQ ID NO: 36989 - DNA, 20 bp, Artificial Sequence
  Description of Artificial Sequence: Synthetic oligonucleotide
  Target: FXN; (+) strand; PAM type: YTN; PAM sequence: CTG
cctcttacttgtttgtagac

SEQ ID NO: 36990 - DNA, 20 bp, Artificial Sequence
  Description of Artificial Sequence: Synthetic oligonucleotide
  Target: FXN; (+) strand; PAM type: YTN; PAM sequence: CTC
ttacttgtttgtagacactg

SEQ ID NO: 36991 - DNA, 20 bp, Artificial Sequence
  Description of Artificial Sequence: Synthetic oligonucleotide
  Target: FXN; (+) strand; PAM type: YTN; PAM sequence: CTT
acttgtttgtagacactgac

SEQ ID NO: 36992 - DNA, 20 bp, Artificial Sequence
  Description of Artificial Sequence: Synthetic oligonucleotide
  Target: FXN; (+) strand; PAM type: YTN; PAM sequence: TTA
cttgtttgtagacactgaca

SEQ ID NO: 36993 - DNA, 20 bp, Artificial Sequence
  Description of Artificial Sequence: Synthetic oligonucleotide
  Target: FXN; (+) strand; PAM type: YTN; PAM sequence: CTT
gtttgtagacactgacagtg

SEQ ID NO: 36994 - DNA, 20 bp, Artificial Sequence
  Description of Artificial Sequence: Synthetic oligonucleotide
  Target: FXN; (+) strand; PAM type: YTN; PAM sequence: TTG
tttgtagacactgacagtgg

SEQ ID NO: 36995 - DNA, 20 bp, Artificial Sequence
  Description of Artificial Sequence: Synthetic oligonucleotide
  Target: FXN; (+) strand; PAM type: YTN; PAM sequence: TTT
gtagacactgacagtggcct

SEQ ID NO: 36996 - DNA, 20 bp, Artificial Sequence
  Description of Artificial Sequence: Synthetic oligonucleotide
  Target: FXN; (+) strand; PAM type: YTN; PAM sequence: TTG
tagacactgacagtggcctc

SEQ ID NO: 36997 - DNA, 20 bp, Artificial Sequence
  Description of Artificial Sequence: Synthetic oligonucleotide
  Target: FXN; (+) strand; PAM type: YTN; PAM sequence: CTG
acagtggcctcatgtttttt

SEQ ID NO: 36998 - DNA, 20 bp, Artificial Sequence
  Description of Artificial Sequence: Synthetic oligonucleotide
  Target: FXN; (+) strand; PAM type: YTN; PAM sequence: CTC
atgttttttttttttttaat

SEQ ID NO: 36999 - DNA, 20 bp, Artificial Sequence
  Description of Artificial Sequence: Synthetic oligonucleotide
  Target: FXN; (+) strand; PAM type: YTN; PAM sequence: TTT
tttttttttttaatctataa

SEQ ID NO: 37000 - DNA, 20 bp, Artificial Sequence
  Description of Artificial Sequence: Synthetic oligonucleotide
  Target: FXN; (+) strand; PAM type: YTN; PAM sequence: TTT
ttttttttttaatctataaa

SEQ ID NO: 37001 - DNA, 20 bp, Artificial Sequence
  Description of Artificial Sequence: Synthetic oligonucleotide
  Target: FXN; (+) strand; PAM type: YTN; PAM sequence: TTT
tttttttttaatctataaaa

SEQ ID NO: 37002 - DNA, 20 bp, Artificial Sequence
  Description of Artificial Sequence: Synthetic oligonucleotide
  Target: FXN; (+) strand; PAM type: YTN; PAM sequence: TTT
ttttttttaatctataaaat

SEQ ID NO: 37003 - DNA, 20 bp, Artificial Sequence
  Description of Artificial Sequence: Synthetic oligonucleotide
  Target: FXN; (+) strand; PAM type: YTN; PAM sequence: TTT
tttttttaatctataaaatg

SEQ ID NO: 37004 - DNA, 20 bp, Artificial Sequence
  Description of Artificial Sequence: Synthetic oligonucleotide
  Target: FXN; (+) strand; PAM type: YTN; PAM sequence: TTT
ttttttaatctataaaatgg

SEQ ID NO: 37005 - DNA, 20 bp, Artificial Sequence
  Description of Artificial Sequence: Synthetic oligonucleotide
  Target: FXN; (+) strand; PAM type: YTN; PAM sequence: TTT
tttttaatctataaaatgga

SEQ ID NO: 37006 - DNA, 20 bp, Artificial Sequence
  Description of Artificial Sequence: Synthetic oligonucleotide
  Target: FXN; (+) strand; PAM type: YTN; PAM sequence: TTT
ttttaatctataaaatggag

SEQ ID NO: 37007 - DNA, 20 bp, Artificial Sequence
  Description of Artificial Sequence: Synthetic oligonucleotide
  Target: FXN; (+) strand; PAM type: YTN; PAM sequence: TTT
tttaatctataaaatggaga

SEQ ID NO: 37008 - DNA, 20 bp, Artificial Sequence
  Description of Artificial Sequence: Synthetic oligonucleotide
  Target: FXN; (+) strand; PAM type: YTN; PAM sequence: TTT
ttaatctataaaatggagat

SEQ ID NO: 37009 - DNA, 20 bp, Artificial Sequence
  Description of Artificial Sequence: Synthetic oligonucleotide
  Target: FXN; (+) strand; PAM type: YTN; PAM sequence: TTT
taatctataaaatggagata

SEQ ID NO: 37010 - DNA, 20 bp, Artificial Sequence
  Description of Artificial Sequence: Synthetic oligonucleotide
  Target: FXN; (+) strand; PAM type: YTN; PAM sequence: TTT
aatctataaaatggagatat

SEQ ID NO: 37011 - DNA, 20 bp, Artificial Sequence
  Description of Artificial Sequence: Synthetic oligonucleotide
  Target: FXN; (+) strand; PAM type: YTN; PAM sequence: TTA
atctataaaatggagatatc

SEQ ID NO: 37012 - DNA, 20 bp, Artificial Sequence
  Description of Artificial Sequence: Synthetic oligonucleotide
  Target: FXN; (+) strand; PAM type: YTN; PAM sequence: CTA
taaaatggagatatctaaca

SEQ ID NO: 37013 - DNA, 20 bp, Artificial Sequence
  Description of Artificial Sequence: Synthetic oligonucleotide
  Target: FXN; (+) strand; PAM type: YTN; PAM sequence: CTA
acatgttgagcctgggccca

SEQ ID NO: 37014 - DNA, 20 bp, Artificial Sequence
  Description of Artificial Sequence: Synthetic oligonucleotide
  Target: FXN; (+) strand; PAM type: YTN; PAM sequence: TTG
agcctgggcccacaggcaaa

SEQ ID NO: 37015 - DNA, 20 bp, Artificial Sequence
  Description of Artificial Sequence: Synthetic oligonucleotide
  Target: FXN; (+) strand; PAM type: YTN; PAM sequence: CTG
ggcccacaggcaaagcacaa

SEQ ID NO: 37016 - DNA, 20 bp, Artificial Sequence
  Description of Artificial Sequence: Synthetic oligonucleotide
  Target: FXN; (+) strand; PAM type: YTN; PAM sequence: CTG
atgtgagaagtactcagttc

SEQ ID NO: 37017 - DNA, 20 bp, Artificial Sequence
  Description of Artificial Sequence: Synthetic oligonucleotide
  Target: FXN; (+) strand; PAM type: YTN; PAM sequence: CTC
agttcatgacaactgttgtt

SEQ ID NO: 37018 - DNA, 20 bp, Artificial Sequence
  Description of Artificial Sequence: Synthetic oligonucleotide
  Target: FXN; (+) strand; PAM type: YTN; PAM sequence: TTC
atgacaactgttgttctcac

SEQ ID NO: 37019 - DNA, 20 bp, Artificial Sequence
  Description of Artificial Sequence: Synthetic oligonucleotide
  Target: FXN; (+) strand; PAM type: YTN; PAM sequence: CTG
ttgttctcacatgcatagca

SEQ ID NO: 37020 - DNA, 20 bp, Artificial Sequence
  Description of Artificial Sequence: Synthetic oligonucleotide
  Target: FXN; (+) strand; PAM type: YTN; PAM sequence: TTG
ttctcacatgcatagcataa

SEQ ID NO: 37021 - DNA, 20 bp, Artificial Sequence
  Description of Artificial Sequence: Synthetic oligonucleotide
  Target: FXN; (+) strand; PAM type: YTN; PAM sequence: TTC
tcacatgcatagcataattt

SEQ ID NO: 37022 - DNA, 20 bp, Artificial Sequence
  Description of Artificial Sequence: Synthetic oligonucleotide
  Target: FXN; (+) strand; PAM type: YTN; PAM sequence: CTC
acatgcatagcataatttca

SEQ ID NO: 37023 - DNA, 20 bp, Artificial Sequence
  Description of Artificial Sequence: Synthetic oligonucleotide
  Target: FXN; (+) strand; PAM type: YTN; PAM sequence: TTT
catattcacattggaggact

SEQ ID NO: 37024 - DNA, 20 bp, Artificial Sequence
  Description of Artificial Sequence: Synthetic oligonucleotide
  Target: FXN; (+) strand; PAM type: YTN; PAM sequence: TTC
atattcacattggaggactt

SEQ ID NO: 37025 - DNA, 20 bp, Artificial Sequence
  Description of Artificial Sequence: Synthetic oligonucleotide
  Target: FXN; (+) strand; PAM type: YTN; PAM sequence: TTC
acattggaggacttctccca

SEQ ID NO: 37026 - DNA, 20 bp, Artificial Sequence
  Description of Artificial Sequence: Synthetic oligonucleotide
  Target: FXN; (+) strand; PAM type: YTN; PAM sequence: TTG
gaggacttctcccaaaatat

SEQ ID NO: 37027 - DNA, 20 bp, Artificial Sequence
  Description of Artificial Sequence: Synthetic oligonucleotide
  Target: FXN; (+) strand; PAM type: YTN; PAM sequence: CTT
ctcccaaaatatggatgacg

SEQ ID NO: 37028 - DNA, 20 bp, Artificial Sequence
  Description of Artificial Sequence: Synthetic oligonucleotide
  Target: FXN; (+) strand; PAM type: YTN; PAM sequence: TTC
tcccaaaatatggatgacgt

SEQ ID NO: 37029 - DNA, 20 bp, Artificial Sequence
  Description of Artificial Sequence: Synthetic oligonucleotide
  Target: FXN; (+) strand; PAM type: YTN; PAM sequence: CTC
ccaaaatatggatgacgttc

SEQ ID NO: 37030 - DNA, 20 bp, Artificial Sequence
  Description of Artificial Sequence: Synthetic oligonucleotide
  Target: FXN; (+) strand; PAM type: YTN; PAM sequence: TTC
cctactcaaccttgaactta

SEQ ID NO: 37031 - DNA, 20 bp, Artificial Sequence
  Description of Artificial Sequence: Synthetic oligonucleotide
  Target: FXN; (+) strand; PAM type: YTN; PAM sequence: CTA
ctcaaccttgaacttaatca

SEQ ID NO: 37032 - DNA, 20 bp, Artificial Sequence
  Description of Artificial Sequence: Synthetic oligonucleotide
  Target: FXN; (+) strand; PAM type: YTN; PAM sequence: CTC
aaccttgaacttaatcaaaa

SEQ ID NO: 37033 - DNA, 20 bp, Artificial Sequence
  Description of Artificial Sequence: Synthetic oligonucleotide
  Target: FXN; (+) strand; PAM type: YTN; PAM sequence: CTT
gaacttaatcaaaatactca

SEQ ID NO: 37034 - DNA, 20 bp, Artificial Sequence
  Description of Artificial Sequence: Synthetic oligonucleotide
  Target: FXN; (+) strand; PAM type: YTN; PAM sequence: TTG
aacttaatcaaaatactcag

SEQ ID NO: 37035 - DNA, 20 bp, Artificial Sequence
  Description of Artificial Sequence: Synthetic oligonucleotide
  Target: FXN; (+) strand; PAM type: YTN; PAM sequence: CTT
aatcaaaatactcagtttac

SEQ ID NO: 37036 - DNA, 20 bp, Artificial Sequence
  Description of Artificial Sequence: Synthetic oligonucleotide
  Target: FXN; (+) strand; PAM type: YTN; PAM sequence: TTA
atcaaaatactcagtttact

SEQ ID NO: 37037 - DNA, 20 bp, Artificial Sequence
  Description of Artificial Sequence: Synthetic oligonucleotide
  Target: FXN; (+) strand; PAM type: YTN; PAM sequence: CTC
agtttacttaacttcgtatt

SEQ ID NO: 37038 - DNA, 20 bp, Artificial Sequence
  Description of Artificial Sequence: Synthetic oligonucleotide
  Target: FXN; (+) strand; PAM type: YTN; PAM sequence: TTT
acttaacttcgtattagatt

SEQ ID NO: 37039 - DNA, 20 bp, Artificial Sequence
  Description of Artificial Sequence: Synthetic oligonucleotide
  Target: FXN; (+) strand; PAM type: YTN; PAM sequence: TTA
cttaacttcgtattagattc

SEQ ID NO: 37040 - DNA, 20 bp, Artificial Sequence
  Description of Artificial Sequence: Synthetic oligonucleotide
  Target: FXN; (+) strand; PAM type: YTN; PAM sequence: CTT
aacttcgtattagattctga

SEQ ID NO: 37041 - DNA, 20 bp, Artificial Sequence
  Description of Artificial Sequence: Synthetic oligonucleotide
  Target: FXN; (+) strand; PAM type: YTN; PAM sequence: TTA
acttcgtattagattctgat

SEQ ID NO: 37042 - DNA, 20 bp, Artificial Sequence
  Description of Artificial Sequence: Synthetic oligonucleotide
  Target: FXN; (+) strand; PAM type: YTN; PAM sequence: CTT
cgtattagattctgattccc

SEQ ID NO: 37043 - DNA, 20 bp, Artificial Sequence
  Description of Artificial Sequence: Synthetic oligonucleotide
  Target: FXN; (+) strand; PAM type: YTN; PAM sequence: TTC
gtattagattctgattccct

SEQ ID NO: 37044 - DNA, 20 bp, Artificial Sequence
  Description of Artificial Sequence: Synthetic oligonucleotide
  Target: FXN; (+) strand; PAM type: YTN; PAM sequence: TTA
gattctgattccctggaacc

SEQ ID NO: 37045 - DNA, 20 bp, Artificial Sequence
  Description of Artificial Sequence: Synthetic oligonucleotide
  Target: FXN; (+) strand; PAM type: YTN; PAM sequence: TTC
tgattccctggaaccattta

SEQ ID NO: 37046 - DNA, 20 bp, Artificial Sequence
  Description of Artificial Sequence: Synthetic oligonucleotide
  Target: FXN; (+) strand; PAM type: YTN; PAM sequence: CTG
attccctggaaccatttatc

SEQ ID NO: 37047 - DNA, 20 bp, Artificial Sequence
  Description of Artificial Sequence: Synthetic oligonucleotide
  Target: FXN; (+) strand; PAM type: YTN; PAM sequence: TTC
cctggaaccatttatcgtgt

SEQ ID NO: 37048 - DNA, 20 bp, Artificial Sequence
  Description of Artificial Sequence: Synthetic oligonucleotide
  Target: FXN; (+) strand; PAM type: YTN; PAM sequence: CTG
gaaccatttatcgtgtgcct

SEQ ID NO: 37049 - DNA, 20 bp, Artificial Sequence
  Description of Artificial Sequence: Synthetic oligonucleotide
  Target: FXN; (+) strand; PAM type: YTN; PAM sequence: TTT
atcgtgtgccttaccatgct

SEQ ID NO: 37050 - DNA, 20 bp, Artificial Sequence
  Description of Artificial Sequence: Synthetic oligonucleotide
  Target: FXN; (+) strand; PAM type: YTN; PAM sequence: TTA
tcgtgtgccttaccatgctt

SEQ ID NO: 37051 - DNA, 20 bp, Artificial Sequence
  Description of Artificial Sequence: Synthetic oligonucleotide
  Target: FXN; (+) strand; PAM type: YTN; PAM sequence: CTT
accatgcttatattttactt

SEQ ID NO: 37052 - DNA, 20 bp, Artificial Sequence
  Description of Artificial Sequence: Synthetic oligonucleotide
  Target: FXN; (+) strand; PAM type: YTN; PAM sequence: TTA
ccatgcttatattttacttg

SEQ ID NO: 37053 - DNA, 20 bp, Artificial Sequence
  Description of Artificial Sequence: Synthetic oligonucleotide
  Target: FXN; (+) strand; PAM type: YTN; PAM sequence: CTT
atattttacttgatcttttg

SEQ ID NO: 37054 - DNA, 20 bp, Artificial Sequence
  Description of Artificial Sequence: Synthetic oligonucleotide
  Target: FXN; (+) strand; PAM type: YTN; PAM sequence: TTA
tattttacttgatcttttgc

SEQ ID NO: 37055 - DNA, 20 bp, Artificial Sequence
  Description of Artificial Sequence: Synthetic oligonucleotide
  Target: FXN; (+) strand; PAM type: YTN; PAM sequence: TTT
tacttgatcttttgcatacc

SEQ ID NO: 37056 - DNA, 20 bp, Artificial Sequence
  Description of Artificial Sequence: Synthetic oligonucleotide
  Target: FXN; (+) strand; PAM type: YTN; PAM sequence: TTT
acttgatcttttgcatacct

SEQ ID NO: 37057 - DNA, 20 bp, Artificial Sequence
  Description of Artificial Sequence: Synthetic oligonucleotide
  Target: FXN; (+) strand; PAM type: YTN; PAM sequence: TTA
cttgatcttttgcatacctt

SEQ ID NO: 37058 - DNA, 20 bp, Artificial Sequence
  Description of Artificial Sequence: Synthetic oligonucleotide
  Target: FXN; (+) strand; PAM type: YTN; PAM sequence: CTT
gatcttttgcataccttcta

SEQ ID NO: 37059 - DNA, 20 bp, Artificial Sequence
  Description of Artificial Sequence: Synthetic oligonucleotide
  Target: FXN; (+) strand; PAM type: YTN; PAM sequence: TTG
atcttttgcataccttctaa

SEQ ID NO: 37060 - DNA, 20 bp, Artificial Sequence
  Description of Artificial Sequence: Synthetic oligonucleotide
  Target: FXN; (+) strand; PAM type: YTN; PAM sequence: CTT
ttgcataccttctaaaacta

SEQ ID NO: 37061 - DNA, 20 bp, Artificial Sequence
  Description of Artificial Sequence: Synthetic oligonucleotide
  Target: FXN; (+) strand; PAM type: YTN; PAM sequence: TTT
tgcataccttctaaaactat

SEQ ID NO: 37062 - DNA, 20 bp, Artificial Sequence
  Description of Artificial Sequence: Synthetic oligonucleotide
  Target: FXN; (+) strand; PAM type: YTN; PAM sequence: TTT
gcataccttctaaaactatt

SEQ ID NO: 37063 - DNA, 20 bp, Artificial Sequence
  Description of Artificial Sequence: Synthetic oligonucleotide
  Target: FXN; (+) strand; PAM type: YTN; PAM sequence: TTG
cataccttctaaaactattt

SEQ ID NO: 37064 - DNA, 20 bp, Artificial Sequence
  Description of Artificial Sequence: Synthetic oligonucleotide
  Target: FXN; (+) strand; PAM type: YTN; PAM sequence: CTT
ctaaaactattttagccaat

SEQ ID NO: 37065 - DNA, 20 bp, Artificial Sequence
  Description of Artificial Sequence: Synthetic oligonucleotide
  Target: FXN; (+) strand; PAM type: YTN; PAM sequence: TTC
taaaactattttagccaatt

SEQ ID NO: 37066 - DNA, 20 bp, Artificial Sequence
  Description of Artificial Sequence: Synthetic oligonucleotide
  Target: FXN; (+) strand; PAM type: YTN; PAM sequence: CTA
aaactattttagccaattta

SEQ ID NO: 37067 - DNA, 20 bp, Artificial Sequence
  Description of Artificial Sequence: Synthetic oligonucleotide
  Target: FXN; (+) strand; PAM type: YTN; PAM sequence: CTA
ttttagccaatttaaaattt

SEQ ID NO: 37068 - DNA, 20 bp, Artificial Sequence
  Description of Artificial Sequence: Synthetic oligonucleotide
  Target: FXN; (+) strand; PAM type: YTN; PAM sequence: TTT
tagccaatttaaaatttgac

SEQ ID NO: 37069 - DNA, 20 bp, Artificial Sequence
  Description of Artificial Sequence: Synthetic oligonucleotide
  Target: FXN; (+) strand; PAM type: YTN; PAM sequence: TTT
agccaatttaaaatttgaca

SEQ ID NO: 37070 - DNA, 20 bp, Artificial Sequence
  Description of Artificial Sequence: Synthetic oligonucleotide
  Target: FXN; (+) strand; PAM type: YTN; PAM sequence: TTA
gccaatttaaaatttgacag

SEQ ID NO: 37071 - DNA, 20 bp, Artificial Sequence
  Description of Artificial Sequence: Synthetic oligonucleotide
  Target: FXN; (+) strand; PAM type: YTN; PAM sequence: TTT
aaaatttgacagtttgcatt

SEQ ID NO: 37072 - DNA, 20 bp, Artificial Sequence
  Description of Artificial Sequence: Synthetic oligonucleotide
  Target: FXN; (+) strand; PAM type: YTN; PAM sequence: TTA
aaatttgacagtttgcatta

SEQ ID NO: 37073 - DNA, 20 bp, Artificial Sequence
  Description of Artificial Sequence: Synthetic oligonucleotide
  Target: FXN; (+) strand; PAM type: YTN; PAM sequence: TTT
gacagtttgcattaaattat

SEQ ID NO: 37074 - DNA, 20 bp, Artificial Sequence
  Description of Artificial Sequence: Synthetic oligonucleotide
  Target: FXN; (+) strand; PAM type: YTN; PAM sequence: TTG
acagtttgcattaaattata

SEQ ID NO: 37075 - DNA, 20 bp, Artificial Sequence
  Description of Artificial Sequence: Synthetic oligonucleotide
  Target: FXN; (+) strand; PAM type: YTN; PAM sequence: TTT
gcattaaattataggtttac

SEQ ID NO: 37076 - DNA, 20 bp, Artificial Sequence
  Description of Artificial Sequence: Synthetic oligonucleotide
  Target: FXN; (+) strand; PAM type: YTN; PAM sequence: TTG
cattaaattataggtttaca

SEQ ID NO: 37077 - DNA, 20 bp, Artificial Sequence
  Description of Artificial Sequence: Synthetic oligonucleotide
  Target: FXN; (+) strand; PAM type: YTN; PAM sequence: TTA
aattataggtttacaatatg

SEQ ID NO: 37078 - DNA, 20 bp, Artificial Sequence
  Description of Artificial Sequence: Synthetic oligonucleotide
  Target: FXN; (+) strand; PAM type: YTN; PAM sequence: TTA
taggtttacaatatgcttta

SEQ ID NO: 37079 - DNA, 20 bp, Artificial Sequence
  Description of Artificial Sequence: Synthetic oligonucleotide
  Target: FXN; (+) strand; PAM type: YTN; PAM sequence: TTT
acaatatgctttatccagct

SEQ ID NO: 37080 - DNA, 20 bp, Artificial Sequence
  Description of Artificial Sequence: Synthetic oligonucleotide
  Target: FXN; (+) strand; PAM type: YTN; PAM sequence: TTA
caatatgctttatccagcta

SEQ ID NO: 37081 - DNA, 20 bp, Artificial Sequence
  Description of Artificial Sequence: Synthetic oligonucleotide
  Target: FXN; (+) strand; PAM type: YTN; PAM sequence: CTT
tatccagctatacctgcccc

SEQ ID NO: 37082 - DNA, 20 bp, Artificial Sequence
  Description of Artificial Sequence: Synthetic oligonucleotide
  Target: FXN; (+) strand; PAM type: YTN; PAM sequence: TTT
atccagctatacctgcccca

SEQ ID NO: 37083 - DNA, 20 bp, Artificial Sequence
  Description of Artificial Sequence: Synthetic oligonucleotide
  Target: FXN; (+) strand; PAM type: YTN; PAM sequence: TTA
tccagctatacctgccccaa

SEQ ID NO: 37084 - DNA, 20 bp, Artificial Sequence
  Description of Artificial Sequence: Synthetic oligonucleotide
  Target: FXN; (+) strand; PAM type: YTN; PAM sequence: CTA
tacctgccccaaattctgac

SEQ ID NO: 37085 - DNA, 20 bp, Artificial Sequence
  Description of Artificial Sequence: Synthetic oligonucleotide
  Target: FXN; (+) strand; PAM type: YTN; PAM sequence: CTG
ccccaaattctgacagatgc

SEQ ID NO: 37086 - DNA, 20 bp, Artificial Sequence
  Description of Artificial Sequence: Synthetic oligonucleotide
  Target: FXN; (+) strand; PAM type: YTN; PAM sequence: TTC
tgacagatgcttttgccacc

SEQ ID NO: 37087 - DNA, 20 bp, Artificial Sequence
  Description of Artificial Sequence: Synthetic oligonucleotide
  Target: FXN; (+) strand; PAM type: YTN; PAM sequence: CTG
acagatgcttttgccacctc

SEQ ID NO: 37088 - DNA, 20 bp, Artificial Sequence
  Description of Artificial Sequence: Synthetic oligonucleotide
  Target: FXN; (+) strand; PAM type: YTN; PAM sequence: CTT
ttgccacctctaaaggaaga

SEQ ID NO: 37089 - DNA, 20 bp, Artificial Sequence
  Description of Artificial Sequence: Synthetic oligonucleotide
  Target: FXN; (+) strand; PAM type: YTN; PAM sequence: TTT
tgccacctctaaaggaagac

SEQ ID NO: 37090 - DNA, 20 bp, Artificial Sequence
  Description of Artificial Sequence: Synthetic oligonucleotide
  Target: FXN; (+) strand; PAM type: YTN; PAM sequence: TTT
gccacctctaaaggaagacc

SEQ ID NO: 37091 - DNA, 20 bp, Artificial Sequence
  Description of Artificial Sequence: Synthetic oligonucleotide
  Target: FXN; (+) strand; PAM type: YTN; PAM sequence: TTG
ccacctctaaaggaagaccc

SEQ ID NO: 37092 - DNA, 20 bp, Artificial Sequence
  Description of Artificial Sequence: Synthetic oligonucleotide
  Target: FXN; (+) strand; PAM type: YTN; PAM sequence: CTC
taaaggaagacccatgttca

SEQ ID NO: 37093 - DNA, 20 bp, Artificial Sequence
  Description of Artificial Sequence: Synthetic oligonucleotide
  Target: FXN; (+) strand; PAM type: YTN; PAM sequence: CTA
aaggaagacccatgttcata

SEQ ID NO: 37094 - DNA, 20 bp, Artificial Sequence
  Description of Artificial Sequence: Synthetic oligonucleotide
  Target: FXN; (+) strand; PAM type: YTN; PAM sequence: TTC
atagtgatggagtttgtgtg

SEQ ID NO: 37095 - DNA, 20 bp, Artificial Sequence
  Description of Artificial Sequence: Synthetic oligonucleotide
  Target: FXN; (+) strand; PAM type: YTN; PAM sequence: TTT
gtgtggactaaccatgcaag

SEQ ID NO: 37096 - DNA, 20 bp, Artificial Sequence
  Description of Artificial Sequence: Synthetic oligonucleotide
  Target: FXN; (+) strand; PAM type: YTN; PAM sequence: TTG
tgtggactaaccatgcaagg

SEQ ID NO: 37097 - DNA, 20 bp, Artificial Sequence
  Description of Artificial Sequence: Synthetic oligonucleotide
  Target: FXN; (+) strand; PAM type: YTN; PAM sequence: CTA
accatgcaaggttgccaagg

SEQ ID NO: 37098 - DNA, 20 bp, Artificial Sequence
  Description of Artificial Sequence: Synthetic oligonucleotide
  Target: FXN; (+) strand; PAM type: YTN; PAM sequence: TTG
ccaaggaaaaatcgctttac

SEQ ID NO: 37099 - DNA, 20 bp, Artificial Sequence
  Description of Artificial Sequence: Synthetic oligonucleotide
  Target: FXN; (+) strand; PAM type: YTN; PAM sequence: CTT
tacgcttccaaggtacacac

SEQ ID NO: 37100 - DNA, 20 bp, Artificial Sequence
  Description of Artificial Sequence: Synthetic oligonucleotide
  Target: FXN; (+) strand; PAM type: YTN; PAM sequence: TTT
acgcttccaaggtacacact

SEQ ID NO: 37101 - DNA, 20 bp, Artificial Sequence
  Description of Artificial Sequence: Synthetic oligonucleotide
  Target: FXN; (+) strand; PAM type: YTN; PAM sequence: TTA
cgcttccaaggtacacacta

SEQ ID NO: 37102 - DNA, 20 bp, Artificial Sequence
  Description of Artificial Sequence: Synthetic oligonucleotide
  Target: FXN; (+) strand; PAM type: YTN; PAM sequence: CTT
ccaaggtacacactaagatg

SEQ ID NO: 37103 - DNA, 20 bp, Artificial Sequence
  Description of Artificial Sequence: Synthetic oligonucleotide
  Target: FXN; (+) strand; PAM type: YTN; PAM sequence: TTC
caaggtacacactaagatga

SEQ ID NO: 37104 - DNA, 20 bp, Artificial Sequence
  Description of Artificial Sequence: Synthetic oligonucleotide
  Target: FXN; (+) strand; PAM type: YTN; PAM sequence: CTA
agatgaaagtaattttagtc

SEQ ID NO: 37105 - DNA, 20 bp, Artificial Sequence
  Description of Artificial Sequence: Synthetic oligonucleotide
  Target: FXN; (+) strand; PAM type: YTN; PAM sequence: TTT
tagtccgtgtccagttggat

SEQ ID NO: 37106 - DNA, 20 bp, Artificial Sequence
  Description of Artificial Sequence: Synthetic oligonucleotide
  Target: FXN; (+) strand; PAM type: YTN; PAM sequence: TTT
agtccgtgtccagttggatt

SEQ ID NO: 37107 - DNA, 20 bp, Artificial Sequence
  Description of Artificial Sequence: Synthetic oligonucleotide
  Target: FXN; (+) strand; PAM type: YTN; PAM sequence: TTA
gtccgtgtccagttggattc

SEQ ID NO: 37108 - DNA, 20 bp, Artificial Sequence
  Description of Artificial Sequence: Synthetic oligonucleotide
  Target: FXN; (+) strand; PAM type: YTN; PAM sequence: TTG
gattcttggcacatagttat

SEQ ID NO: 37109 - DNA, 20 bp, Artificial Sequence
  Description of Artificial Sequence: Synthetic oligonucleotide
  Target: FXN; (+) strand; PAM type: YTN; PAM sequence: TTC
ttggcacatagttatcttct

SEQ ID NO: 37110 - DNA, 20 bp, Artificial Sequence
  Description of Artificial Sequence: Synthetic oligonucleotide
  Target: FXN; (+) strand; PAM type: YTN; PAM sequence: CTT
ggcacatagttatcttctgc

SEQ ID NO: 37111 - DNA, 20 bp, Artificial Sequence
  Description of Artificial Sequence: Synthetic oligonucleotide
  Target: FXN; (+) strand; PAM type: YTN; PAM sequence: TTG
gcacatagttatcttctgct

SEQ ID NO: 37112 - DNA, 20 bp, Artificial Sequence
  Description of Artificial Sequence: Synthetic oligonucleotide
  Target: FXN; (+) strand; PAM type: YTN; PAM sequence: TTA
tcttctgctagaacaaacta

SEQ ID NO: 37113 - DNA, 20 bp, Artificial Sequence
  Description of Artificial Sequence: Synthetic oligonucleotide
  Target: FXN; (+) strand; PAM type: YTN; PAM sequence: CTT
ctgctagaacaaactaaaac

SEQ ID NO: 37114 - DNA, 20 bp, Artificial Sequence
  Description of Artificial Sequence: Synthetic oligonucleotide
  Target: FXN; (+) strand; PAM type: YTN; PAM sequence: TTC
tgctagaacaaactaaaaca

SEQ ID NO: 37115 - DNA, 20 bp, Artificial Sequence
  Description of Artificial Sequence: Synthetic oligonucleotide
  Target: FXN; (+) strand; PAM type: YTN; PAM sequence: CTG
ctagaacaaactaaaacagc

SEQ ID NO: 37116 - DNA, 20 bp, Artificial Sequence
  Description of Artificial Sequence: Synthetic oligonucleotide
  Target: FXN; (+) strand; PAM type: YTN; PAM sequence: CTA
gaacaaactaaaacagctac

SEQ ID NO: 37117 - DNA, 20 bp, Artificial Sequence
  Description of Artificial Sequence: Synthetic oligonucleotide
  Target: FXN; (+) strand; PAM type: YTN; PAM sequence: CTA
aaacagctacatgccagcaa

SEQ ID NO: 37118 - DNA, 20 bp, Artificial Sequence
  Description of Artificial Sequence: Synthetic oligonucleotide
  Target: FXN; (+) strand; PAM type: YTN; PAM sequence: CTA
catgccagcaagggagaaag

SEQ ID NO: 37119 - DNA, 20 bp, Artificial Sequence
  Description of Artificial Sequence: Synthetic oligonucleotide
  Target: FXN; (+) strand; PAM type: YTN; PAM sequence: TTT
tgaaatttcatgtaaattta

SEQ ID NO: 37120 - DNA, 20 bp, Artificial Sequence
  Description of Artificial Sequence: Synthetic oligonucleotide
  Target: FXN; (+) strand; PAM type: YTN; PAM sequence: TTT
gaaatttcatgtaaatttat

SEQ ID NO: 37121 - DNA, 20 bp, Artificial Sequence
  Description of Artificial Sequence: Synthetic oligonucleotide
  Target: FXN; (+) strand; PAM type: YTN; PAM sequence: TTG
aaatttcatgtaaatttatg

SEQ ID NO: 37122 - DNA, 20 bp, Artificial Sequence
  Description of Artificial Sequence: Synthetic oligonucleotide
  Target: FXN; (+) strand; PAM type: YTN; PAM sequence: TTT
catgtaaatttatgctgttc

SEQ ID NO: 37123 - DNA, 20 bp, Artificial Sequence
  Description of Artificial Sequence: Synthetic oligonucleotide
  Target: FXN; (+) strand; PAM type: YTN; PAM sequence: TTC
atgtaaatttatgctgttca

SEQ ID NO: 37124 - DNA, 20 bp, Artificial Sequence
  Description of Artificial Sequence: Synthetic oligonucleotide
  Target: FXN; (+) strand; PAM type: YTN; PAM sequence: TTT
atgctgttcaaaacgacgag

SEQ ID NO: 37125 - DNA, 20 bp, Artificial Sequence
  Description of Artificial Sequence: Synthetic oligonucleotide
  Target: FXN; (+) strand; PAM type: YTN; PAM sequence: TTA
tgctgttcaaaacgacgagt

SEQ ID NO: 37126 - DNA, 20 bp, Artificial Sequence
  Description of Artificial Sequence: Synthetic oligonucleotide
  Target: FXN; (+) strand; PAM type: YTN; PAM sequence: CTG
ttcaaaacgacgagttcatg

SEQ ID NO: 37127 - DNA, 20 bp, Artificial Sequence
  Description of Artificial Sequence: Synthetic oligonucleotide
  Target: FXN; (+) strand; PAM type: YTN; PAM sequence: TTC
aaaacgacgagttcatgact

SEQ ID NO: 37128 - DNA, 20 bp, Artificial Sequence
  Description of Artificial Sequence: Synthetic oligonucleotide
  Target: FXN; (+) strand; PAM type: YTN; PAM sequence: TTC
atgactttgtgtatagagta

SEQ ID NO: 37129 - DNA, 20 bp, Artificial Sequence
  Description of Artificial Sequence: Synthetic oligonucleotide
  Target: FXN; (+) strand; PAM type: YTN; PAM sequence: CTT
tgtgtatagagtaagaaatg

SEQ ID NO: 37130 - DNA, 20 bp, Artificial Sequence
  Description of Artificial Sequence: Synthetic oligonucleotide
  Target: FXN; (+) strand; PAM type: YTN; PAM sequence: TTT
gtgtatagagtaagaaatgc

SEQ ID NO: 37131 - DNA, 20 bp, Artificial Sequence
  Description of Artificial Sequence: Synthetic oligonucleotide
  Target: FXN; (+) strand; PAM type: YTN; PAM sequence: TTG
tgtatagagtaagaaatgcc

SEQ ID NO: 37132 - DNA, 20 bp, Artificial Sequence
  Description of Artificial Sequence: Synthetic oligonucleotide
  Target: FXN; (+) strand; PAM type: YTN; PAM sequence: CTT
ttcttttttgagacagagtc

SEQ ID NO: 37133 - DNA, 20 bp, Artificial Sequence
  Description of Artificial Sequence: Synthetic oligonucleotide
  Target: FXN; (+) strand; PAM type: YTN; PAM sequence: TTT
tcttttttgagacagagtct

SEQ ID NO: 37134 - DNA, 20 bp, Artificial Sequence
  Description of Artificial Sequence: Synthetic oligonucleotide
  Target: FXN; (+) strand; PAM type: YTN; PAM sequence: TTT
cttttttgagacagagtctt

SEQ ID NO: 37135 - DNA, 20 bp, Artificial Sequence
  Description of Artificial Sequence: Synthetic oligonucleotide
  Target: FXN; (+) strand; PAM type: YTN; PAM sequence: TTC
ttttttgagacagagtcttg

SEQ ID NO: 37136 - DNA, 20 bp, Artificial Sequence
  Description of Artificial Sequence: Synthetic oligonucleotide
  Target: FXN; (+) strand; PAM type: YTN; PAM sequence: CTT
ttttgagacagagtcttgct

SEQ ID NO: 37137 - DNA, 20 bp, Artificial Sequence
  Description of Artificial Sequence: Synthetic oligonucleotide
  Target: FXN; (+) strand; PAM type: YTN; PAM sequence: TTT
tttgagacagagtcttgctc

SEQ ID NO: 37138 - DNA, 20 bp, Artificial Sequence
  Description of Artificial Sequence: Synthetic oligonucleotide
  Target: FXN; (+) strand; PAM type: YTN; PAM sequence: TTT
ttgagacagagtcttgctct

SEQ ID NO: 37139 - DNA, 20 bp, Artificial Sequence
  Description of Artificial Sequence: Synthetic oligonucleotide
  Target: FXN; (+) strand; PAM type: YTN; PAM sequence: TTT
tgagacagagtcttgctctg

SEQ ID NO: 37140 - DNA, 20 bp, Artificial Sequence
  Description of Artificial Sequence: Synthetic oligonucleotide
  Target: FXN; (+) strand; PAM type: YTN; PAM sequence: TTT
gagacagagtcttgctctgt

SEQ ID NO: 37141 - DNA, 20 bp, Artificial Sequence
  Description of Artificial Sequence: Synthetic oligonucleotide
  Target: FXN; (+) strand; PAM type: YTN; PAM sequence: TTG
agacagagtcttgctctgtc

SEQ ID NO: 37142 - DNA, 20 bp, Artificial Sequence
  Description of Artificial Sequence: Synthetic oligonucleotide
  Target: FXN; (+) strand; PAM type: YTN; PAM sequence: CTT
gctctgtcacccaggctgga

SEQ ID NO: 37143 - DNA, 20 bp, Artificial Sequence
  Description of Artificial Sequence: Synthetic oligonucleotide
  Target: FXN; (+) strand; PAM type: YTN; PAM sequence: TTG
ctctgtcacccaggctggag

SEQ ID NO: 37144 - DNA, 20 bp, Artificial Sequence
  Description of Artificial Sequence: Synthetic oligonucleotide
  Target: FXN; (+) strand; PAM type: YTN; PAM sequence: CTC
tgtcacccaggctggagtgc

SEQ ID NO: 37145 - DNA, 20 bp, Artificial Sequence
  Description of Artificial Sequence: Synthetic oligonucleotide
  Target: FXN; (+) strand; PAM type: YTN; PAM sequence: CTG
tcacccaggctggagtgcag

SEQ ID NO: 37146 - DNA, 20 bp, Artificial Sequence
  Description of Artificial Sequence: Synthetic oligonucleotide
  Target: FXN; (+) strand; PAM type: YTN; PAM sequence: CTG
gagtgcagtggcacgatctg

SEQ ID NO: 37147 - DNA, 20 bp, Artificial Sequence
  Description of Artificial Sequence: Synthetic oligonucleotide
  Target: FXN; (+) strand; PAM type: YTN; PAM sequence: CTG
ggctcactacaacctccgcc

SEQ ID NO: 37148 - DNA, 20 bp, Artificial Sequence
  Description of Artificial Sequence: Synthetic oligonucleotide
  Target: FXN; (+) strand; PAM type: YTN; PAM sequence: CTC
actacaacctccgcctcctg

SEQ ID NO: 37149 - DNA, 20 bp, Artificial Sequence
  Description of Artificial Sequence: Synthetic oligonucleotide
  Target: FXN; (+) strand; PAM type: YTN; PAM sequence: CTA
caacctccgcctcctgggtt

SEQ ID NO: 37150 - DNA, 20 bp, Artificial Sequence
  Description of Artificial Sequence: Synthetic oligonucleotide
  Target: FXN; (+) strand; PAM type: YTN; PAM sequence: CTC
cgcctcctgggttcaagcaa

SEQ ID NO: 37151 - DNA, 20 bp, Artificial Sequence
  Description of Artificial Sequence: Synthetic oligonucleotide
  Target: FXN; (+) strand; PAM type: YTN; PAM sequence: CTC
ctgggttcaagcaattctct

SEQ ID NO: 37152 - DNA, 20 bp, Artificial Sequence
  Description of Artificial Sequence: Synthetic oligonucleotide
  Target: FXN; (+) strand; PAM type: YTN; PAM sequence: CTG
ggttcaagcaattctctgcc

SEQ ID NO: 37153 - DNA, 20 bp, Artificial Sequence
  Description of Artificial Sequence: Synthetic oligonucleotide
  Target: FXN; (+) strand; PAM type: YTN; PAM sequence: TTC
aagcaattctctgcctcagc

SEQ ID NO: 37154 - DNA, 20 bp, Artificial Sequence
  Description of Artificial Sequence: Synthetic oligonucleotide
  Target: FXN; (+) strand; PAM type: YTN; PAM sequence: TTC
tctgcctcagcctcccgagt

SEQ ID NO: 37155 - DNA, 20 bp, Artificial Sequence
  Description of Artificial Sequence: Synthetic oligonucleotide
  Target: FXN; (+) strand; PAM type: YTN; PAM sequence: CTC
tgcctcagcctcccgagtag

SEQ ID NO: 37156 - DNA, 20 bp, Artificial Sequence
  Description of Artificial Sequence: Synthetic oligonucleotide
  Target: FXN; (+) strand; PAM type: YTN; PAM sequence: CTG
cctcagcctcccgagtagct

SEQ ID NO: 37157 - DNA, 20 bp, Artificial Sequence
  Description of Artificial Sequence: Synthetic oligonucleotide
  Target: FXN; (+) strand; PAM type: YTN; PAM sequence: CTC
agcctcccgagtagctggga

SEQ ID NO: 37158 - DNA, 20 bp, Artificial Sequence
  Description of Artificial Sequence: Synthetic oligonucleotide
  Target: FXN; (+) strand; PAM type: YTN; PAM sequence: CTC
ccgagtagctgggattacag

SEQ ID NO: 37159 - DNA, 20 bp, Artificial Sequence
  Description of Artificial Sequence: Synthetic oligonucleotide
  Target: FXN; (+) strand; PAM type: YTN; PAM sequence: CTG
ggattacaggtgcctgccac

SEQ ID NO: 37160 - DNA, 20 bp, Artificial Sequence
  Description of Artificial Sequence: Synthetic oligonucleotide
  Target: FXN; (+) strand; PAM type: YTN; PAM sequence: TTA
caggtgcctgccaccacacc

SEQ ID NO: 37161 - DNA, 20 bp, Artificial Sequence
  Description of Artificial Sequence: Synthetic oligonucleotide
  Target: FXN; (+) strand; PAM type: YTN; PAM sequence: CTG
ccaccacacccggctaattt

SEQ ID NO: 37162 - DNA, 20 bp, Artificial Sequence
  Description of Artificial Sequence: Synthetic oligonucleotide
  Target: FXN; (+) strand; PAM type: YTN; PAM sequence: CTA
atttttgtatttttagtaga

SEQ ID NO: 37163 - DNA, 20 bp, Artificial Sequence
  Description of Artificial Sequence: Synthetic oligonucleotide
  Target: FXN; (+) strand; PAM type: YTN; PAM sequence: TTT
ttgtatttttagtagagacg

SEQ ID NO: 37164 - DNA, 20 bp, Artificial Sequence
  Description of Artificial Sequence: Synthetic oligonucleotide
  Target: FXN; (+) strand; PAM type: YTN; PAM sequence: TTT
tgtatttttagtagagacgg

SEQ ID NO: 37165 - DNA, 20 bp, Artificial Sequence
  Description of Artificial Sequence: Synthetic oligonucleotide
  Target: FXN; (+) strand; PAM type: YTN; PAM sequence: TTT
gtatttttagtagagacggg

SEQ ID NO: 37166 - DNA, 20 bp, Artificial Sequence
  Description of Artificial Sequence: Synthetic oligonucleotide
  Target: FXN; (+) strand; PAM type: YTN; PAM sequence: TTG
tatttttagtagagacgggg

SEQ ID NO: 37167 - DNA, 20 bp, Artificial Sequence
  Description of Artificial Sequence: Synthetic oligonucleotide
  Target: FXN; (+) strand; PAM type: YTN; PAM sequence: TTT
ttagtagagacggggtttca

SEQ ID NO: 37168 - DNA, 20 bp, Artificial Sequence
  Description of Artificial Sequence: Synthetic oligonucleotide
  Target: FXN; (+) strand; PAM type: YTN; PAM sequence: TTT
tagtagagacggggtttcac

SEQ ID NO: 37169 - DNA, 20 bp, Artificial Sequence
  Description of Artificial Sequence: Synthetic oligonucleotide
  Target: FXN; (+) strand; PAM type: YTN; PAM sequence: TTT
agtagagacggggtttcacc

SEQ ID NO: 37170 - DNA, 20 bp, Artificial Sequence
  Description of Artificial Sequence: Synthetic oligonucleotide
  Target: FXN; (+) strand; PAM type: YTN; PAM sequence: TTA
gtagagacggggtttcacca

SEQ ID NO: 37171 - DNA, 20 bp, Artificial Sequence
  Description of Artificial Sequence: Synthetic oligonucleotide
  Target: FXN; (+) strand; PAM type: YTN; PAM sequence: TTT
caccatcatggccaggctgg

SEQ ID NO: 37172 - DNA, 20 bp, Artificial Sequence
  Description of Artificial Sequence: Synthetic oligonucleotide
  Target: FXN; (+) strand; PAM type: YTN; PAM sequence: TTC
accatcatggccaggctggt

SEQ ID NO: 37173 - DNA, 20 bp, Artificial Sequence
  Description of Artificial Sequence: Synthetic oligonucleotide
  Target: FXN; (+) strand; PAM type: YTN; PAM sequence: CTG
gtcttgaactcctgacctag

SEQ ID NO: 37174 - DNA, 20 bp, Artificial Sequence
  Description of Artificial Sequence: Synthetic oligonucleotide
  Target: FXN; (+) strand; PAM type: YTN; PAM sequence: CTT
gaactcctgacctagtaatc

SEQ ID NO: 37175 - DNA, 20 bp, Artificial Sequence
  Description of Artificial Sequence: Synthetic oligonucleotide
  Target: FXN; (+) strand; PAM type: YTN; PAM sequence: TTG
aactcctgacctagtaatcc

SEQ ID NO: 37176 - DNA, 20 bp, Artificial Sequence
  Description of Artificial Sequence: Synthetic oligonucleotide
  Target: FXN; (+) strand; PAM type: YTN; PAM sequence: CTC
ctgacctagtaatccacctg

SEQ ID NO: 37177 - DNA, 20 bp, Artificial Sequence
  Description of Artificial Sequence: Synthetic oligonucleotide
  Target: FXN; (+) strand; PAM type: YTN; PAM sequence: CTG
acctagtaatccacctgcct

SEQ ID NO: 37178 - DNA, 20 bp, Artificial Sequence
  Description of Artificial Sequence: Synthetic oligonucleotide
  Target: FXN; (+) strand; PAM type: YTN; PAM sequence: CTA
gtaatccacctgcctccgcc

SEQ ID NO: 37179 - DNA, 20 bp, Artificial Sequence
  Description of Artificial Sequence: Synthetic oligonucleotide
  Target: FXN; (+) strand; PAM type: YTN; PAM sequence: CTG
cctccgcctcccaaagtgct

SEQ ID NO: 37180 - DNA, 20 bp, Artificial Sequence
  Description of Artificial Sequence: Synthetic oligonucleotide
  Target: FXN; (+) strand; PAM type: YTN; PAM sequence: CTC
cgcctcccaaagtgctggga

SEQ ID NO: 37181 - DNA, 20 bp, Artificial Sequence
  Description of Artificial Sequence: Synthetic oligonucleotide
  Target: FXN; (+) strand; PAM type: YTN; PAM sequence: CTC
ccaaagtgctgggattacag

SEQ ID NO: 37182 - DNA, 20 bp, Artificial Sequence
  Description of Artificial Sequence: Synthetic oligonucleotide
  Target: FXN; (+) strand; PAM type: YTN; PAM sequence: CTG
ggattacaggcgtgagccac

SEQ ID NO: 37183 - DNA, 20 bp, Artificial Sequence
  Description of Artificial Sequence: Synthetic oligonucleotide
  Target: FXN; (+) strand; PAM type: YTN; PAM sequence: TTA
caggcgtgagccactgcacc

SEQ ID NO: 37184 - DNA, 20 bp, Artificial Sequence
  Description of Artificial Sequence: Synthetic oligonucleotide
  Target: FXN; (+) strand; PAM type: YTN; PAM sequence: CTG
cacccagccagaaatgcctt

SEQ ID NO: 37185 - DNA, 20 bp, Artificial Sequence
  Description of Artificial Sequence: Synthetic oligonucleotide
  Target: FXN; (+) strand; PAM type: YTN; PAM sequence: CTT
ctaatctttggtttatctta

SEQ ID NO: 37186 - DNA, 20 bp, Artificial Sequence
  Description of Artificial Sequence: Synthetic oligonucleotide
  Target: FXN; (+) strand; PAM type: YTN; PAM sequence: TTC
taatctttggtttatcttaa

SEQ ID NO: 37187 - DNA, 20 bp, Artificial Sequence
  Description of Artificial Sequence: Synthetic oligonucleotide
  Target: FXN; (+) strand; PAM type: YTN; PAM sequence: CTA
atctttggtttatcttaatt

SEQ ID NO: 37188 - DNA, 20 bp, Artificial Sequence
  Description of Artificial Sequence: Synthetic oligonucleotide
  Target: FXN; (+) strand; PAM type: YTN; PAM sequence: CTT
tggtttatcttaattagcca

SEQ ID NO: 37189 - DNA, 20 bp, Artificial Sequence
  Description of Artificial Sequence: Synthetic oligonucleotide
  Target: FXN; (+) strand; PAM type: YTN; PAM sequence: TTT
ggtttatcttaattagccag

SEQ ID NO: 37190 - DNA, 20 bp, Artificial Sequence
  Description of Artificial Sequence: Synthetic oligonucleotide
  Target: FXN; (+) strand; PAM type: YTN; PAM sequence: TTG
gtttatcttaattagccagg

SEQ ID NO: 37191 - DNA, 20 bp, Artificial Sequence
  Description of Artificial Sequence: Synthetic oligonucleotide
  Target: FXN; (+) strand; PAM type: YTN; PAM sequence: TTT
atcttaattagccaggacac

SEQ ID NO: 37192 - DNA, 20 bp, Artificial Sequence
  Description of Artificial Sequence: Synthetic oligonucleotide
  Target: FXN; (+) strand; PAM type: YTN; PAM sequence: TTA
tcttaattagccaggacact

SEQ ID NO: 37193 - DNA, 20 bp, Artificial Sequence
  Description of Artificial Sequence: Synthetic oligonucleotide
  Target: FXN; (+) strand; PAM type: YTN; PAM sequence: CTT
aattagccaggacacttgga

SEQ ID NO: 37194 - DNA, 20 bp, Artificial Sequence
  Description of Artificial Sequence: Synthetic oligonucleotide
  Target: FXN; (+) strand; PAM type: YTN; PAM sequence: TTA
attagccaggacacttggag

SEQ ID NO: 37195 - DNA, 20 bp, Artificial Sequence
  Description of Artificial Sequence: Synthetic oligonucleotide
  Target: FXN; (+) strand; PAM type: YTN; PAM sequence: TTA
gccaggacacttggagtgca

SEQ ID NO: 37196 - DNA, 20 bp, Artificial Sequence
  Description of Artificial Sequence: Synthetic oligonucleotide
  Target: FXN; (+) strand; PAM type: YTN; PAM sequence: CTT
ggagtgcatcccgaagtacc

SEQ ID NO: 37197 - DNA, 20 bp, Artificial Sequence
  Description of Artificial Sequence: Synthetic oligonucleotide
  Target: FXN; (+) strand; PAM type: YTN; PAM sequence: TTG
gagtgcatcccgaagtacct

SEQ ID NO: 37198 - DNA, 20 bp, Artificial Sequence
  Description of Artificial Sequence: Synthetic oligonucleotide
  Target: FXN; (+) strand; PAM type: YTN; PAM sequence: CTG
atcagtggcccctttggaat

SEQ ID NO: 37199 - DNA, 20 bp, Artificial Sequence
  Description of Artificial Sequence: Synthetic oligonucleotide
  Target: FXN; (+) strand; PAM type: YTN; PAM sequence: CTT
tggaatgtgtaaaactcagc

SEQ ID NO: 37200 - DNA, 20 bp, Artificial Sequence
  Description of Artificial Sequence: Synthetic oligonucleotide
  Target: FXN; (+) strand; PAM type: YTN; PAM sequence: TTT
ggaatgtgtaaaactcagct

SEQ ID NO: 37201 - DNA, 20 bp, Artificial Sequence
  Description of Artificial Sequence: Synthetic oligonucleotide
  Target: FXN; (+) strand; PAM type: YTN; PAM sequence: TTG
gaatgtgtaaaactcagctc

SEQ ID NO: 37202 - DNA, 20 bp, Artificial Sequence
  Description of Artificial Sequence: Synthetic oligonucleotide
  Target: FXN; (+) strand; PAM type: YTN; PAM sequence: CTC
agctcacttatatccctgca

SEQ ID NO: 37203 - DNA, 20 bp, Artificial Sequence
  Description of Artificial Sequence: Synthetic oligonucleotide
  Target: FXN; (+) strand; PAM type: YTN; PAM sequence: CTC
acttatatccctgcatccgc

SEQ ID NO: 37204 - DNA, 20 bp, Artificial Sequence
  Description of Artificial Sequence: Synthetic oligonucleotide
  Target: FXN; (+) strand; PAM type: YTN; PAM sequence: CTT
atatccctgcatccgctaca

SEQ ID NO: 37205 - DNA, 20 bp, Artificial Sequence
  Description of Artificial Sequence: Synthetic oligonucleotide
  Target: FXN; (+) strand; PAM type: YTN; PAM sequence: TTA
tatccctgcatccgctacag

SEQ ID NO: 37206 - DNA, 20 bp, Artificial Sequence
  Description of Artificial Sequence: Synthetic oligonucleotide
  Target: FXN; (+) strand; PAM type: YTN; PAM sequence: CTG
catccgctacagagacagaa

SEQ ID NO: 37207 - DNA, 20 bp, Artificial Sequence
  Description of Artificial Sequence: Synthetic oligonucleotide
  Target: FXN; (+) strand; PAM type: YTN; PAM sequence: CTA
cagagacagaatccaagctc

SEQ ID NO: 37208 - DNA, 20 bp, Artificial Sequence
  Description of Artificial Sequence: Synthetic oligonucleotide
  Target: FXN; (+) strand; PAM type: YTN; PAM sequence: CTC
atatgttccatcttctctgg

SEQ ID NO: 37209 - DNA, 20 bp, Artificial Sequence
  Description of Artificial Sequence: Synthetic oligonucleotide
  Target: FXN; (+) strand; PAM type: YTN; PAM sequence: TTC
catcttctctggctgtatag

SEQ ID NO: 37210 - DNA, 20 bp, Artificial Sequence
  Description of Artificial Sequence: Synthetic oligonucleotide
  Target: FXN; (+) strand; PAM type: YTN; PAM sequence: CTT
ctctggctgtatagtttaag

SEQ ID NO: 37211 - DNA, 20 bp, Artificial Sequence
  Description of Artificial Sequence: Synthetic oligonucleotide
  Target: FXN; (+) strand; PAM type: YTN; PAM sequence: TTC
tctggctgtatagtttaagg

SEQ ID NO: 37212 - DNA, 20 bp, Artificial Sequence
  Description of Artificial Sequence: Synthetic oligonucleotide
  Target: FXN; (+) strand; PAM type: YTN; PAM sequence: CTC
tggctgtatagtttaaggaa

SEQ ID NO: 37213 - DNA, 20 bp, Artificial Sequence
  Description of Artificial Sequence: Synthetic oligonucleotide
  Target: FXN; (+) strand; PAM type: YTN; PAM sequence: CTG
gctgtatagtttaaggaatg

SEQ ID NO: 37214 - DNA, 20 bp, Artificial Sequence
  Description of Artificial Sequence: Synthetic oligonucleotide
  Target: FXN; (+) strand; PAM type: YTN; PAM sequence: CTG
tatagtttaaggaatggaag

SEQ ID NO: 37215 - DNA, 20 bp, Artificial Sequence
  Description of Artificial Sequence: Synthetic oligonucleotide
  Target: FXN; (+) strand; PAM type: YTN; PAM sequence: TTT
aaggaatggaaggcaccaga

SEQ ID NO: 37216 - DNA, 20 bp, Artificial Sequence
  Description of Artificial Sequence: Synthetic oligonucleotide
  Target: FXN; (+) strand; PAM type: YTN; PAM sequence: TTA
aggaatggaaggcaccagaa

SEQ ID NO: 37217 - DNA, 20 bp, Artificial Sequence
  Description of Artificial Sequence: Synthetic oligonucleotide
  Target: FXN; (+) strand; PAM type: YTN; PAM sequence: TTT
attgaaatgtttattagctg

SEQ ID NO: 37218 - DNA, 20 bp, Artificial Sequence
  Description of Artificial Sequence: Synthetic oligonucleotide
  Target: FXN; (+) strand; PAM type: YTN; PAM sequence: TTA
ttgaaatgtttattagctga

SEQ ID NO: 37219 - DNA, 20 bp, Artificial Sequence
  Description of Artificial Sequence: Synthetic oligonucleotide
  Target: FXN; (+) strand; PAM type: YTN; PAM sequence: TTG
aaatgtttattagctgaaga

SEQ ID NO: 37220 - DNA, 20 bp, Artificial Sequence
  Description of Artificial Sequence: Synthetic oligonucleotide
  Target: FXN; (+) strand; PAM type: YTN; PAM sequence: TTT
attagctgaagatttattta

SEQ ID NO: 37221 - DNA, 20 bp, Artificial Sequence
  Description of Artificial Sequence: Synthetic oligonucleotide
  Target: FXN; (+) strand; PAM type: YTN; PAM sequence: TTA
ttagctgaagatttatttag

SEQ ID NO: 37222 - DNA, 20 bp, Artificial Sequence
  Description of Artificial Sequence: Synthetic oligonucleotide
  Target: FXN; (+) strand; PAM type: YTN; PAM sequence: TTA
gctgaagatttatttagaca

SEQ ID NO: 37223 - DNA, 20 bp, Artificial Sequence
  Description of Artificial Sequence: Synthetic oligonucleotide
  Target: FXN; (+) strand; PAM type: YTN; PAM sequence: CTG
aagatttatttagacagttg

SEQ ID NO: 37224 - DNA, 20 bp, Artificial Sequence
  Description of Artificial Sequence: Synthetic oligonucleotide
  Target: FXN; (+) strand; PAM type: YTN; PAM sequence: TTT
atttagacagttgaggaaaa

SEQ ID NO: 37225 - DNA, 20 bp, Artificial Sequence
  Description of Artificial Sequence: Synthetic oligonucleotide
  Target: FXN; (+) strand; PAM type: YTN; PAM sequence: TTA
tttagacagttgaggaaaac

SEQ ID NO: 37226 - DNA, 20 bp, Artificial Sequence
  Description of Artificial Sequence: Synthetic oligonucleotide
  Target: FXN; (+) strand; PAM type: YTN; PAM sequence: TTT
agacagttgaggaaaacatc

SEQ ID NO: 37227 - DNA, 20 bp, Artificial Sequence
  Description of Artificial Sequence: Synthetic oligonucleotide
  Target: FXN; (+) strand; PAM type: YTN; PAM sequence: TTA
gacagttgaggaaaacatca

SEQ ID NO: 37228 - DNA, 20 bp, Artificial Sequence
  Description of Artificial Sequence: Synthetic oligonucleotide
  Target: FXN; (+) strand; PAM type: YTN; PAM sequence: TTG
aggaaaacatcagcacccag

SEQ ID NO: 37229 - DNA, 20 bp, Artificial Sequence
  Description of Artificial Sequence: Synthetic oligonucleotide
  Target: FXN; (+) strand; PAM type: YTN; PAM sequence: TTG
gctctcaaagattttcttct

SEQ ID NO: 37230 - DNA, 20 bp, Artificial Sequence
  Description of Artificial Sequence: Synthetic oligonucleotide
  Target: FXN; (+) strand; PAM type: YTN; PAM sequence: CTC
tcaaagattttcttctcctg

SEQ ID NO: 37231 - DNA, 20 bp, Artificial Sequence
  Description of Artificial Sequence: Synthetic oligonucleotide
  Target: FXN; (+) strand; PAM type: YTN; PAM sequence: CTC
aaagattttcttctcctgtg

SEQ ID NO: 37232 - DNA, 20 bp, Artificial Sequence
  Description of Artificial Sequence: Synthetic oligonucleotide
  Target: FXN; (+) strand; PAM type: YTN; PAM sequence: TTT
tcttctcctgtggaaagtca

SEQ ID NO: 37233 - DNA, 20 bp, Artificial Sequence
  Description of Artificial Sequence: Synthetic oligonucleotide
  Target: FXN; (+) strand; PAM type: YTN; PAM sequence: TTT
cttctcctgtggaaagtcag

SEQ ID NO: 37234 - DNA, 20 bp, Artificial Sequence
  Description of Artificial Sequence: Synthetic oligonucleotide
  Target: FXN; (+) strand; PAM type: YTN; PAM sequence: TTC
ttctcctgtggaaagtcaga

SEQ ID NO: 37235 - DNA, 20 bp, Artificial Sequence
  Description of Artificial Sequence: Synthetic oligonucleotide
  Target: FXN; (+) strand; PAM type: YTN; PAM sequence: CTT
ctcctgtggaaagtcagacc

SEQ ID NO: 37236 - DNA, 20 bp, Artificial Sequence
  Description of Artificial Sequence: Synthetic oligonucleotide
  Target: FXN; (+) strand; PAM type: YTN; PAM sequence: TTC
tcctgtggaaagtcagacct

SEQ ID NO: 37237 - DNA, 20 bp, Artificial Sequence
  Description of Artificial Sequence: Synthetic oligonucleotide
  Target: FXN; (+) strand; PAM type: YTN; PAM sequence: CTC
ctgtggaaagtcagacctct

SEQ ID NO: 37238 - DNA, 20 bp, Artificial Sequence
  Description of Artificial Sequence: Synthetic oligonucleotide
  Target: FXN; (+) strand; PAM type: YTN; PAM sequence: CTG
tggaaagtcagacctctgag

SEQ ID NO: 37239 - DNA, 20 bp, Artificial Sequence
  Description of Artificial Sequence: Synthetic oligonucleotide
  Target: FXN; (+) strand; PAM type: YTN; PAM sequence: CTC
tgaggccccatccaggtaga

SEQ ID NO: 37240 - DNA, 20 bp, Artificial Sequence
  Description of Artificial Sequence: Synthetic oligonucleotide
  Target: FXN; (+) strand; PAM type: YTN; PAM sequence: CTG
aggccccatccaggtagaag

SEQ ID NO: 37241 - DNA, 20 bp, Artificial Sequence
  Description of Artificial Sequence: Synthetic oligonucleotide
  Target: FXN; (+) strand; PAM type: YTN; PAM sequence: CTA
gtgcaagaagggcctctgct

SEQ ID NO: 37242 - DNA, 20 bp, Artificial Sequence
  Description of Artificial Sequence: Synthetic oligonucleotide
  Target: FXN; (+) strand; PAM type: YTN; PAM sequence: CTC
tgctgtccacttgtgtttct

SEQ ID NO: 37243 - DNA, 20 bp, Artificial Sequence
  Description of Artificial Sequence: Synthetic oligonucleotide
  Target: FXN; (+) strand; PAM type: YTN; PAM sequence: CTG
ctgtccacttgtgtttctgt

SEQ ID NO: 37244 - DNA, 20 bp, Artificial Sequence
  Description of Artificial Sequence: Synthetic oligonucleotide
  Target: FXN; (+) strand; PAM type: YTN; PAM sequence: CTG
tccacttgtgtttctgtgat

SEQ ID NO: 37245 - DNA, 20 bp, Artificial Sequence
  Description of Artificial Sequence: Synthetic oligonucleotide
  Target: FXN; (+) strand; PAM type: YTN; PAM sequence: CTT
gtgtttctgtgatctgtggg

SEQ ID NO: 37246 - DNA, 20 bp, Artificial Sequence
  Description of Artificial Sequence: Synthetic oligonucleotide
  Target: FXN; (+) strand; PAM type: YTN; PAM sequence: TTG
tgtttctgtgatctgtggga

SEQ ID NO: 37247 - DNA, 20 bp, Artificial Sequence
  Description of Artificial Sequence: Synthetic oligonucleotide
  Target: FXN; (+) strand; PAM type: YTN; PAM sequence: TTT
ctgtgatctgtgggaacatt

SEQ ID NO: 37248 - DNA, 20 bp, Artificial Sequence
  Description of Artificial Sequence: Synthetic oligonucleotide
  Target: FXN; (+) strand; PAM type: YTN; PAM sequence: TTC
tgtgatctgtgggaacattg

SEQ ID NO: 37249 - DNA, 20 bp, Artificial Sequence
  Description of Artificial Sequence: Synthetic oligonucleotide
  Target: FXN; (+) strand; PAM type: YTN; PAM sequence: CTG
tgatctgtgggaacattgtt

SEQ ID NO: 37250 - DNA, 20 bp, Artificial Sequence
  Description of Artificial Sequence: Synthetic oligonucleotide
  Target: FXN; (+) strand; PAM type: YTN; PAM sequence: CTG
tgggaacattgttaacgcca

SEQ ID NO: 37251 - DNA, 20 bp, Artificial Sequence
  Description of Artificial Sequence: Synthetic oligonucleotide
  Target: FXN; (+) strand; PAM type: YTN; PAM sequence: TTG
ttaacgccacatcttgacct

SEQ ID NO: 37252 - DNA, 20 bp, Artificial Sequence
  Description of Artificial Sequence: Synthetic oligonucleotide
  Target: FXN; (+) strand; PAM type: YTN; PAM sequence: TTA
acgccacatcttgacctcaa

SEQ ID NO: 37253 - DNA, 20 bp, Artificial Sequence
  Description of Artificial Sequence: Synthetic oligonucleotide
  Target: FXN; (+) strand; PAM type: YTN; PAM sequence: CTT
gacctcaaattgtttagctc

SEQ ID NO: 37254 - DNA, 20 bp, Artificial Sequence
  Description of Artificial Sequence: Synthetic oligonucleotide
  Target: FXN; (+) strand; PAM type: YTN; PAM sequence: TTG
acctcaaattgtttagctcc

SEQ ID NO: 37255 - DNA, 20 bp, Artificial Sequence
  Description of Artificial Sequence: Synthetic oligonucleotide
  Target: FXN; (+) strand; PAM type: YTN; PAM sequence: CTC
aaattgtttagctcctggcc

SEQ ID NO: 37256 - DNA, 20 bp, Artificial Sequence
  Description of Artificial Sequence: Synthetic oligonucleotide
  Target: FXN; (+) strand; PAM type: YTN; PAM sequence: TTG
tttagctcctggccagacac

SEQ ID NO: 37257 - DNA, 20 bp, Artificial Sequence
  Description of Artificial Sequence: Synthetic oligonucleotide
  Target: FXN; (+) strand; PAM type: YTN; PAM sequence: TTT
agctcctggccagacacggt

SEQ ID NO: 37258 - DNA, 20 bp, Artificial Sequence
  Description of Artificial Sequence: Synthetic oligonucleotide
  Target: FXN; (+) strand; PAM type: YTN; PAM sequence: TTA
gctcctggccagacacggtg

SEQ ID NO: 37259 - DNA, 20 bp, Artificial Sequence
  Description of Artificial Sequence: Synthetic oligonucleotide
  Target: FXN; (+) strand; PAM type: YTN; PAM sequence: CTC
ctggccagacacggtggctc

SEQ ID NO: 37260 - DNA, 20 bp, Artificial Sequence
  Description of Artificial Sequence: Synthetic oligonucleotide
  Target: FXN; (+) strand; PAM type: YTN; PAM sequence: CTG
gccagacacggtggctcaca

SEQ ID NO: 37261 - DNA, 20 bp, Artificial Sequence
  Description of Artificial Sequence: Synthetic oligonucleotide
  Target: FXN; (+) strand; PAM type: YTN; PAM sequence: CTC
acacctgtaatcccagcact

SEQ ID NO: 37262 - DNA, 20 bp, Artificial Sequence
  Description of Artificial Sequence: Synthetic oligonucleotide
  Target: FXN; (+) strand; PAM type: YTN; PAM sequence: CTG
taatcccagcactttgagag

SEQ ID NO: 37263 - DNA, 20 bp, Artificial Sequence
  Description of Artificial Sequence: Synthetic oligonucleotide
  Target: FXN; (+) strand; PAM type: YTN; PAM sequence: CTT
tgagaggctgaggcaggtgg

SEQ ID NO: 37264 - DNA, 20 bp, Artificial Sequence
  Description of Artificial Sequence: Synthetic oligonucleotide
  Target: FXN; (+) strand; PAM type: YTN; PAM sequence: TTT
gagaggctgaggcaggtgga

SEQ ID NO: 37265 - DNA, 20 bp, Artificial Sequence
  Description of Artificial Sequence: Synthetic oligonucleotide
  Target: FXN; (+) strand; PAM type: YTN; PAM sequence: TTG
agaggctgaggcaggtggat

SEQ ID NO: 37266 - DNA, 20 bp, Artificial Sequence
  Description of Artificial Sequence: Synthetic oligonucleotide
  Target: FXN; (+) strand; PAM type: YTN; PAM sequence: CTG
aggcaggtggatcacctgag

SEQ ID NO: 37267 - DNA, 20 bp, Artificial Sequence
  Description of Artificial Sequence: Synthetic oligonucleotide
  Target: FXN; (+) strand; PAM type: YTN; PAM sequence: CTG
aggttaggagttcgaggcca

SEQ ID NO: 37268 - DNA, 20 bp, Artificial Sequence
  Description of Artificial Sequence: Synthetic oligonucleotide
  Target: FXN; (+) strand; PAM type: YTN; PAM sequence: TTA
ggagttcgaggccagcctgg

SEQ ID NO: 37269 - DNA, 20 bp, Artificial Sequence
  Description of Artificial Sequence: Synthetic oligonucleotide
  Target: FXN; (+) strand; PAM type: YTN; PAM sequence: TTC
gaggccagcctggtcaacat

SEQ ID NO: 37270 - DNA, 20 bp, Artificial Sequence
  Description of Artificial Sequence: Synthetic oligonucleotide
  Target: FXN; (+) strand; PAM type: YTN; PAM sequence: CTG
gtcaacatggtaaaaccccg

SEQ ID NO: 37271 - DNA, 20 bp, Artificial Sequence
  Description of Artificial Sequence: Synthetic oligonucleotide
  Target: FXN; (+) strand; PAM type: YTN; PAM sequence: CTC
tactaaaaatacaaaaatta

SEQ ID NO: 37272 - DNA, 20 bp, Artificial Sequence
  Description of Artificial Sequence: Synthetic oligonucleotide
  Target: FXN; (+) strand; PAM type: YTN; PAM sequence: CTA
ctaaaaatacaaaaattagc

SEQ ID NO: 37273 - DNA, 20 bp, Artificial Sequence
  Description of Artificial Sequence: Synthetic oligonucleotide
  Target: FXN; (+) strand; PAM type: YTN; PAM sequence: CTA
aaaatacaaaaattagctgg

SEQ ID NO: 37274 - DNA, 20 bp, Artificial Sequence
  Description of Artificial Sequence: Synthetic oligonucleotide
  Target: FXN; (+) strand; PAM type: YTN; PAM sequence: TTA
gctggccgtagtggcgcacg

SEQ ID NO: 37275 - DNA, 20 bp, Artificial Sequence
  Description of Artificial Sequence: Synthetic oligonucleotide
  Target: FXN; (+) strand; PAM type: YTN; PAM sequence: CTG
gccgtagtggcgcacgcctg

SEQ ID NO: 37276 - DNA, 20 bp, Artificial Sequence
  Description of Artificial Sequence: Synthetic oligonucleotide
  Target: FXN; (+) strand; PAM type: YTN; PAM sequence: CTG
ttatcccagctactcgggag

SEQ ID NO: 37277 - DNA, 20 bp, Artificial Sequence
  Description of Artificial Sequence: Synthetic oligonucleotide
  Target: FXN; (+) strand; PAM type: YTN; PAM sequence: TTA
tcccagctactcgggaggct

SEQ ID NO: 37278 - DNA, 20 bp, Artificial Sequence
  Description of Artificial Sequence: Synthetic oligonucleotide
  Target: FXN; (+) strand; PAM type: YTN; PAM sequence: CTA
ctcgggaggctgaggcagga

SEQ ID NO: 37279 - DNA, 20 bp, Artificial Sequence
  Description of Artificial Sequence: Synthetic oligonucleotide
  Target: FXN; (+) strand; PAM type: YTN; PAM sequence: CTC
gggaggctgaggcaggagaa

SEQ ID NO: 37280 - DNA, 20 bp, Artificial Sequence
  Description of Artificial Sequence: Synthetic oligonucleotide
  Target: FXN; (+) strand; PAM type: YTN; PAM sequence: CTG
aggcaggagaattgcttgaa

SEQ ID NO: 37281 - DNA, 20 bp, Artificial Sequence
  Description of Artificial Sequence: Synthetic oligonucleotide
  Target: FXN; (+) strand; PAM type: YTN; PAM sequence: TTG
cttgaacctgggtggtggag

SEQ ID NO: 37282 - DNA, 20 bp, Artificial Sequence
  Description of Artificial Sequence: Synthetic oligonucleotide
  Target: FXN; (+) strand; PAM type: YTN; PAM sequence: CTT
gaacctgggtggtggaggtt

SEQ ID NO: 37283 - DNA, 20 bp, Artificial Sequence
  Description of Artificial Sequence: Synthetic oligonucleotide
  Target: FXN; (+) strand; PAM type: YTN; PAM sequence: TTG
aacctgggtggtggaggttg

SEQ ID NO: 37284 - DNA, 20 bp, Artificial Sequence
  Description of Artificial Sequence: Synthetic oligonucleotide
  Target: FXN; (+) strand; PAM type: YTN; PAM sequence: CTG
ggtggtggaggttgcagtga

SEQ ID NO: 37285 - DNA, 20 bp, Artificial Sequence
  Description of Artificial Sequence: Synthetic oligonucleotide
  Target: FXN; (+) strand; PAM type: YTN; PAM sequence: TTG
cagtgagccgagattacacc

SEQ ID NO: 37286 - DNA, 20 bp, Artificial Sequence
  Description of Artificial Sequence: Synthetic oligonucleotide
  Target: FXN; (+) strand; PAM type: YTN; PAM sequence: TTA
caccactgcactccagcctg

SEQ ID NO: 37287 - DNA, 20 bp, Artificial Sequence
  Description of Artificial Sequence: Synthetic oligonucleotide
  Target: FXN; (+) strand; PAM type: YTN; PAM sequence: CTG
cactccagcctgggtgacaa

SEQ ID NO: 37288 - DNA, 20 bp, Artificial Sequence
  Description of Artificial Sequence: Synthetic oligonucleotide
  Target: FXN; (+) strand; PAM type: YTN; PAM sequence: CTC
cagcctgggtgacaagaggg

SEQ ID NO: 37289 - DNA, 20 bp, Artificial Sequence
  Description of Artificial Sequence: Synthetic oligonucleotide
  Target: FXN; (+) strand; PAM type: YTN; PAM sequence: CTG
ggtgacaagagggaaactcc

SEQ ID NO: 37290 - DNA, 20 bp, Artificial Sequence
  Description of Artificial Sequence: Synthetic oligonucleotide
  Target: FXN; (+) strand; PAM type: YTN; PAM sequence: CTC
cattaaaaaaatgtaattcc

SEQ ID NO: 37291 - DNA, 20 bp, Artificial Sequence
  Description of Artificial Sequence: Synthetic oligonucleotide
  Target: FXN; (+) strand; PAM type: YTN; PAM sequence: TTA
aaaaaatgtaattcccgtgt

SEQ ID NO: 37292 - DNA, 20 bp, Artificial Sequence
  Description of Artificial Sequence: Synthetic oligonucleotide
  Target: FXN; (+) strand; PAM type: YTN; PAM sequence: TTC
ccgtgtctgccatcttaagt

SEQ ID NO: 37293 - DNA, 20 bp, Artificial Sequence
  Description of Artificial Sequence: Synthetic oligonucleotide
  Target: FXN; (+) strand; PAM type: YTN; PAM sequence: CTG
ccatcttaagtgtaaaggtg

SEQ ID NO: 37294 - DNA, 20 bp, Artificial Sequence
  Description of Artificial Sequence: Synthetic oligonucleotide
  Target: FXN; (+) strand; PAM type: YTN; PAM sequence: CTT
aagtgtaaaggtggctaaat

SEQ ID NO: 37295 - DNA, 20 bp, Artificial Sequence
  Description of Artificial Sequence: Synthetic oligonucleotide
  Target: FXN; (+) strand; PAM type: YTN; PAM sequence: TTA
agtgtaaaggtggctaaatt

SEQ ID NO: 37296 - DNA, 20 bp, Artificial Sequence
  Description of Artificial Sequence: Synthetic oligonucleotide
  Target: FXN; (+) strand; PAM type: YTN; PAM sequence: CTA
aattatatagaaaaataaga

SEQ ID NO: 37297 - DNA, 20 bp, Artificial Sequence
  Description of Artificial Sequence: Synthetic oligonucleotide
  Target: FXN; (+) strand; PAM type: YTN; PAM sequence: TTA
tatagaaaaataagacaata

SEQ ID NO: 37298 - DNA, 20 bp, Artificial Sequence
  Description of Artificial Sequence: Synthetic oligonucleotide
  Target: FXN; (+) strand; PAM type: YTN; PAM sequence: TTT
cccaattacattcctttcct

SEQ ID NO: 37299 - DNA, 20 bp, Artificial Sequence
  Description of Artificial Sequence: Synthetic oligonucleotide
  Target: FXN; (+) strand; PAM type: YTN; PAM sequence: TTC
ccaattacattcctttccta

SEQ ID NO: 37300 - DNA, 20 bp, Artificial Sequence
  Description of Artificial Sequence: Synthetic oligonucleotide
  Target: FXN; (+) strand; PAM type: YTN; PAM sequence: TTA
cattcctttcctaccgcact

SEQ ID NO: 37301 - DNA, 20 bp, Artificial Sequence
  Description of Artificial Sequence: Synthetic oligonucleotide
  Target: FXN; (+) strand; PAM type: YTN; PAM sequence: TTC
ctttcctaccgcactctatg

SEQ ID NO: 37302 - DNA, 20 bp, Artificial Sequence
  Description of Artificial Sequence: Synthetic oligonucleotide
  Target: FXN; (+) strand; PAM type: YTN; PAM sequence: CTT
tcctaccgcactctatgatg

SEQ ID NO: 37303 - DNA, 20 bp, Artificial Sequence
  Description of Artificial Sequence: Synthetic oligonucleotide
  Target: FXN; (+) strand; PAM type: YTN; PAM sequence: TTT
cctaccgcactctatgatgc

SEQ ID NO: 37304 - DNA, 20 bp, Artificial Sequence
  Description of Artificial Sequence: Synthetic oligonucleotide
  Target: FXN; (+) strand; PAM type: YTN; PAM sequence: TTC
ctaccgcactctatgatgct

SEQ ID NO: 37305 - DNA, 20 bp, Artificial Sequence
  Description of Artificial Sequence: Synthetic oligonucleotide
  Target: FXN; (+) strand; PAM type: YTN; PAM sequence: CTA
ccgcactctatgatgctagc

SEQ ID NO: 37306 - DNA, 20 bp, Artificial Sequence
  Description of Artificial Sequence: Synthetic oligonucleotide
  Target: FXN; (+) strand; PAM type: YTN; PAM sequence: CTC
tatgatgctagctgagattt

SEQ ID NO: 37307 - DNA, 20 bp, Artificial Sequence
  Description of Artificial Sequence: Synthetic oligonucleotide
  Target: FXN; (+) strand; PAM type: YTN; PAM sequence: CTA
tgatgctagctgagattttt

SEQ ID NO: 37308 - DNA, 20 bp, Artificial Sequence
  Description of Artificial Sequence: Synthetic oligonucleotide
  Target: FXN; (+) strand; PAM type: YTN; PAM sequence: CTA
gctgagatttttccaaaaga

SEQ ID NO: 37309 - DNA, 20 bp, Artificial Sequence
  Description of Artificial Sequence: Synthetic oligonucleotide
  Target: FXN; (+) strand; PAM type: YTN; PAM sequence: CTG
agatttttccaaaagaaaat

SEQ ID NO: 37310 - DNA, 20 bp, Artificial Sequence
  Description of Artificial Sequence: Synthetic oligonucleotide
  Target: FXN; (+) strand; PAM type: YTN; PAM sequence: TTT
ttccaaaagaaaatggctta

SEQ ID NO: 37311 - DNA, 20 bp, Artificial Sequence
  Description of Artificial Sequence: Synthetic oligonucleotide
  Target: FXN; (+) strand; PAM type: YTN; PAM sequence: TTT
tccaaaagaaaatggcttaa

SEQ ID NO: 37312 - DNA, 20 bp, Artificial Sequence
  Description of Artificial Sequence: Synthetic oligonucleotide
  Target: FXN; (+) strand; PAM type: YTN; PAM sequence: TTT
ccaaaagaaaatggcttaaa

SEQ ID NO: 37313 - DNA, 20 bp, Artificial Sequence
  Description of Artificial Sequence: Synthetic oligonucleotide
  Target: FXN; (+) strand; PAM type: YTN; PAM sequence: TTC
caaaagaaaatggcttaaat

SEQ ID NO: 37314 - DNA, 20 bp, Artificial Sequence
  Description of Artificial Sequence: Synthetic oligonucleotide
  Target: FXN; (+) strand; PAM type: YTN; PAM sequence: CTT
aaataaaaccctaagagaaa

SEQ ID NO: 37315 - DNA, 20 bp, Artificial Sequence
  Description of Artificial Sequence: Synthetic oligonucleotide
  Target: FXN; (+) strand; PAM type: YTN; PAM sequence: TTA
aataaaaccctaagagaaag

SEQ ID NO: 37316 - DNA, 20 bp, Artificial Sequence
  Description of Artificial Sequence: Synthetic oligonucleotide
  Target: FXN; (+) strand; PAM type: YTN; PAM sequence: CTA
agagaaagaaaaactttaaa

SEQ ID NO: 37317 - DNA, 20 bp, Artificial Sequence
  Description of Artificial Sequence: Synthetic oligonucleotide
  Target: FXN; (+) strand; PAM type: YTN; PAM sequence: CTT
taaatccctccaaagctcaa

SEQ ID NO: 37318 - DNA, 20 bp, Artificial Sequence
  Description of Artificial Sequence: Synthetic oligonucleotide
  Target: FXN; (+) strand; PAM type: YTN; PAM sequence: TTT
aaatccctccaaagctcaaa

SEQ ID NO: 37319 - DNA, 20 bp, Artificial Sequence
  Description of Artificial Sequence: Synthetic oligonucleotide
  Target: FXN; (+) strand; PAM type: YTN; PAM sequence: TTA
aatccctccaaagctcaaaa

SEQ ID NO: 37320 - DNA, 20 bp, Artificial Sequence
  Description of Artificial Sequence: Synthetic oligonucleotide
  Target: FXN; (+) strand; PAM type: YTN; PAM sequence: CTC
caaagctcaaaagtaataga

SEQ ID NO: 37321 - DNA, 20 bp, Artificial Sequence
  Description of Artificial Sequence: Synthetic oligonucleotide
  Target: FXN; (+) strand; PAM type: YTN; PAM sequence: CTC
aaaagtaatagaaacagatg

SEQ ID NO: 37322 - DNA, 20 bp, Artificial Sequence
  Description of Artificial Sequence: Synthetic oligonucleotide
  Target: FXN; (+) strand; PAM type: YTN; PAM sequence: TTT
ggagtcaggatttctctgta

SEQ ID NO: 37323 - DNA, 20 bp, Artificial Sequence
  Description of Artificial Sequence: Synthetic oligonucleotide
  Target: FXN; (+) strand; PAM type: YTN; PAM sequence: TTG
gagtcaggatttctctgtaa

SEQ ID NO: 37324 - DNA, 20 bp, Artificial Sequence
  Description of Artificial Sequence: Synthetic oligonucleotide
  Target: FXN; (+) strand; PAM type: YTN; PAM sequence: TTT
ctctgtaagattgcctaggc

SEQ ID NO: 37325 - DNA, 20 bp, Artificial Sequence
  Description of Artificial Sequence: Synthetic oligonucleotide
  Target: FXN; (+) strand; PAM type: YTN; PAM sequence: TTC
tctgtaagattgcctaggct

SEQ ID NO: 37326 - DNA, 20 bp, Artificial Sequence
  Description of Artificial Sequence: Synthetic oligonucleotide
  Target: FXN; (+) strand; PAM type: YTN; PAM sequence: CTC
tgtaagattgcctaggctgt

SEQ ID NO: 37327 - DNA, 20 bp, Artificial Sequence
  Description of Artificial Sequence: Synthetic oligonucleotide
  Target: FXN; (+) strand; PAM type: YTN; PAM sequence: CTG
taagattgcctaggctgtgt

SEQ ID NO: 37328 - DNA, 20 bp, Artificial Sequence
  Description of Artificial Sequence: Synthetic oligonucleotide
  Target: FXN; (+) strand; PAM type: YTN; PAM sequence: TTG
cctaggctgtgtactgcaca

SEQ ID NO: 37329 - DNA, 20 bp, Artificial Sequence
  Description of Artificial Sequence: Synthetic oligonucleotide
  Target: FXN; (+) strand; PAM type: YTN; PAM sequence: CTA
ggctgtgtactgcacatctc

SEQ ID NO: 37330 - DNA, 20 bp, Artificial Sequence
  Description of Artificial Sequence: Synthetic oligonucleotide
  Target: FXN; (+) strand; PAM type: YTN; PAM sequence: CTG
tgtactgcacatctccaggt

SEQ ID NO: 37331 - DNA, 20 bp, Artificial Sequence
  Description of Artificial Sequence: Synthetic oligonucleotide
  Target: FXN; (+) strand; PAM type: YTN; PAM sequence: CTG
cacatctccaggtgccactg

SEQ ID NO: 37332 - DNA, 20 bp, Artificial Sequence
  Description of Artificial Sequence: Synthetic oligonucleotide
  Target: FXN; (+) strand; PAM type: YTN; PAM sequence: CTC
caggtgccactgttgacaga

SEQ ID NO: 37333 - DNA, 20 bp, Artificial Sequence
  Description of Artificial Sequence: Synthetic oligonucleotide
  Target: FXN; (+) strand; PAM type: YTN; PAM sequence: CTG
ttgacagagattataactac

SEQ ID NO: 37334 - DNA, 20 bp, Artificial Sequence
  Description of Artificial Sequence: Synthetic oligonucleotide
  Target: FXN; (+) strand; PAM type: YTN; PAM sequence: TTG
acagagattataactacaat

SEQ ID NO: 37335 - DNA, 20 bp, Artificial Sequence
  Description of Artificial Sequence: Synthetic oligonucleotide
  Target: FXN; (+) strand; PAM type: YTN; PAM sequence: TTA
taactacaatgtgaagtgaa

SEQ ID NO: 37336 - DNA, 20 bp, Artificial Sequence
  Description of Artificial Sequence: Synthetic oligonucleotide
  Target: FXN; (+) strand; PAM type: YTN; PAM sequence: CTA
caatgtgaagtgaatggtgc

SEQ ID NO: 37337 - DNA, 20 bp, Artificial Sequence
  Description of Artificial Sequence: Synthetic oligonucleotide
  Target: FXN; (+) strand; PAM type: YTN; PAM sequence: CTG
acagttatgcaaaccgtcca

SEQ ID NO: 37338 - DNA, 20 bp, Artificial Sequence
  Description of Artificial Sequence: Synthetic oligonucleotide
  Target: FXN; (+) strand; PAM type: YTN; PAM sequence: TTA
tgcaaaccgtccagagcata

SEQ ID NO: 37339 - DNA, 20 bp, Artificial Sequence
  Description of Artificial Sequence: Synthetic oligonucleotide
  Target: FXN; (+) strand; PAM type: YTN; PAM sequence: CTG
atcctgctgggattcctctt

SEQ ID NO: 37340 - DNA, 20 bp, Artificial Sequence
  Description of Artificial Sequence: Synthetic oligonucleotide
  Target: FXN; (+) strand; PAM type: YTN; PAM sequence: CTG
ctgggattcctcttgccagt

SEQ ID NO: 37341 - DNA, 20 bp, Artificial Sequence
  Description of Artificial Sequence: Synthetic oligonucleotide
  Target: FXN; (+) strand; PAM type: YTN; PAM sequence: CTG
ggattcctcttgccagtcca

SEQ ID NO: 37342 - DNA, 20 bp, Artificial Sequence
  Description of Artificial Sequence: Synthetic oligonucleotide
  Target: FXN; (+) strand; PAM type: YTN; PAM sequence: TTC
ctcttgccagtccatcagca

SEQ ID NO: 37343 - DNA, 20 bp, Artificial Sequence
  Description of Artificial Sequence: Synthetic oligonucleotide
  Target: FXN; (+) strand; PAM type: YTN; PAM sequence: CTC
ttgccagtccatcagcagtt

SEQ ID NO: 37344 - DNA, 20 bp, Artificial Sequence
  Description of Artificial Sequence: Synthetic oligonucleotide
  Target: FXN; (+) strand; PAM type: YTN; PAM sequence: CTT
gccagtccatcagcagttcc

SEQ ID NO: 37345 - DNA, 20 bp, Artificial Sequence
  Description of Artificial Sequence: Synthetic oligonucleotide
  Target: FXN; (+) strand; PAM type: YTN; PAM sequence: TTG
ccagtccatcagcagttccc

SEQ ID NO: 37346 - DNA, 20 bp, Artificial Sequence
  Description of Artificial Sequence: Synthetic oligonucleotide
  Target: FXN; (+) strand; PAM type: YTN; PAM sequence: TTC
cccttgaaagtttcaccaaa

SEQ ID NO: 37347 - DNA, 20 bp, Artificial Sequence
  Description of Artificial Sequence: Synthetic oligonucleotide
  Target: FXN; (+) strand; PAM type: YTN; PAM sequence: CTT
gaaagtttcaccaaacatcc

SEQ ID NO: 37348 - DNA, 20 bp, Artificial Sequence
  Description of Artificial Sequence: Synthetic oligonucleotide
  Target: FXN; (+) strand; PAM type: YTN; PAM sequence: TTG
aaagtttcaccaaacatccc

SEQ ID NO: 37349 - DNA, 20 bp, Artificial Sequence
  Description of Artificial Sequence: Synthetic oligonucleotide
  Target: FXN; (+) strand; PAM type: YTN; PAM sequence: TTT
caccaaacatcccttaaatc

SEQ ID NO: 37350 - DNA, 20 bp, Artificial Sequence
  Description of Artificial Sequence: Synthetic oligonucleotide
  Target: FXN; (+) strand; PAM type: YTN; PAM sequence: TTC
accaaacatcccttaaatct

SEQ ID NO: 37351 - DNA, 20 bp, Artificial Sequence
  Description of Artificial Sequence: Synthetic oligonucleotide
  Target: FXN; (+) strand; PAM type: YTN; PAM sequence: CTT
aaatctgccctctcctgccc

SEQ ID NO: 37352 - DNA, 20 bp, Artificial Sequence
  Description of Artificial Sequence: Synthetic oligonucleotide
  Target: FXN; (+) strand; PAM type: YTN; PAM sequence: TTA
aatctgccctctcctgcccg

SEQ ID NO: 37353 - DNA, 20 bp, Artificial Sequence
  Description of Artificial Sequence: Synthetic oligonucleotide
  Target: FXN; (+) strand; PAM type: YTN; PAM sequence: CTG
ccctctcctgcccgtcccca

SEQ ID NO: 37354 - DNA, 20 bp, Artificial Sequence
  Description of Artificial Sequence: Synthetic oligonucleotide
  Target: FXN; (+) strand; PAM type: YTN; PAM sequence: CTC
tcctgcccgtccccagtgga

SEQ ID NO: 37355 - DNA, 20 bp, Artificial Sequence
  Description of Artificial Sequence: Synthetic oligonucleotide
  Target: FXN; (+) strand; PAM type: YTN; PAM sequence: CTC
ctgcccgtccccagtggagg

SEQ ID NO: 37356 - DNA, 20 bp, Artificial Sequence
  Description of Artificial Sequence: Synthetic oligonucleotide
  Target: FXN; (+) strand; PAM type: YTN; PAM sequence: CTG
cccgtccccagtggaggtcc

SEQ ID NO: 37357 - DNA, 20 bp, Artificial Sequence
  Description of Artificial Sequence: Synthetic oligonucleotide
  Target: FXN; (+) strand; PAM type: YTN; PAM sequence: CTC
atcatttttcacctgcattt

SEQ ID NO: 37358 - DNA, 20 bp, Artificial Sequence
  Description of Artificial Sequence: Synthetic oligonucleotide
  Target: FXN; (+) strand; PAM type: YTN; PAM sequence: TTT
ttcacctgcatttttgcagg

SEQ ID NO: 37359 - DNA, 20 bp, Artificial Sequence
  Description of Artificial Sequence: Synthetic oligonucleotide
  Target: FXN; (+) strand; PAM type: YTN; PAM sequence: TTT
tcacctgcatttttgcagga

SEQ ID NO: 37360 - DNA, 20 bp, Artificial Sequence
  Description of Artificial Sequence: Synthetic oligonucleotide
  Target: FXN; (+) strand; PAM type: YTN; PAM sequence: TTT
cacctgcatttttgcaggag

SEQ ID NO: 37361 - DNA, 20 bp, Artificial Sequence
  Description of Artificial Sequence: Synthetic oligonucleotide
  Target: FXN; (+) strand; PAM type: YTN; PAM sequence: TTC
acctgcatttttgcaggagc

SEQ ID NO: 37362 - DNA, 20 bp, Artificial Sequence
  Description of Artificial Sequence: Synthetic oligonucleotide
  Target: FXN; (+) strand; PAM type: YTN; PAM sequence: CTG
catttttgcaggagctttct

SEQ ID NO: 37363 - DNA, 20 bp, Artificial Sequence
  Description of Artificial Sequence: Synthetic oligonucleotide
  Target: FXN; (+) strand; PAM type: YTN; PAM sequence: TTT
ttgcaggagctttcttatat

SEQ ID NO: 37364 - DNA, 20 bp, Artificial Sequence
  Description of Artificial Sequence: Synthetic oligonucleotide
  Target: FXN; (+) strand; PAM type: YTN; PAM sequence: TTT
tgcaggagctttcttatatc

SEQ ID NO: 37365 - DNA, 20 bp, Artificial Sequence
  Description of Artificial Sequence: Synthetic oligonucleotide
  Target: FXN; (+) strand; PAM type: YTN; PAM sequence: TTT
gcaggagctttcttatatcc

SEQ ID NO: 37366 - DNA, 20 bp, Artificial Sequence
  Description of Artificial Sequence: Synthetic oligonucleotide
  Target: FXN; (+) strand; PAM type: YTN; PAM sequence: TTG
caggagctttcttatatcca

SEQ ID NO: 37367 - DNA, 20 bp, Artificial Sequence
  Description of Artificial Sequence: Synthetic oligonucleotide
  Target: FXN; (+) strand; PAM type: YTN; PAM sequence: CTT
tcttatatccaccttcctcc

SEQ ID NO: 37368 - DNA, 20 bp, Artificial Sequence
  Description of Artificial Sequence: Synthetic oligonucleotide
  Target: FXN; (+) strand; PAM type: YTN; PAM sequence: TTT
cttatatccaccttcctcct

SEQ ID NO: 37369 - DNA, 20 bp, Artificial Sequence
  Description of Artificial Sequence: Synthetic oligonucleotide
  Target: FXN; (+) strand; PAM type: YTN; PAM sequence: TTC
ttatatccaccttcctcctt

SEQ ID NO: 37370 - DNA, 20 bp, Artificial Sequence
  Description of Artificial Sequence: Synthetic oligonucleotide
  Target: FXN; (+) strand; PAM type: YTN; PAM sequence: CTT
atatccaccttcctcctttt

SEQ ID NO: 37371 - DNA, 20 bp, Artificial Sequence
  Description of Artificial Sequence: Synthetic oligonucleotide
  Target: FXN; (+) strand; PAM type: YTN; PAM sequence: TTA
tatccaccttcctccttttc

SEQ ID NO: 37372 - DNA, 20 bp, Artificial Sequence
  Description of Artificial Sequence: Synthetic oligonucleotide
  Target: FXN; (+) strand; PAM type: YTN; PAM sequence: CTT
cctccttttctctcagccca

SEQ ID NO: 37373 - DNA, 20 bp, Artificial Sequence
  Description of Artificial Sequence: Synthetic oligonucleotide
  Target: FXN; (+) strand; PAM type: YTN; PAM sequence: TTC
ctccttttctctcagcccat

SEQ ID NO: 37374 - DNA, 20 bp, Artificial Sequence
  Description of Artificial Sequence: Synthetic oligonucleotide
  Target: FXN; (+) strand; PAM type: YTN; PAM sequence: CTC
cttttctctcagcccatcat

SEQ ID NO: 37375 - DNA, 20 bp, Artificial Sequence
  Description of Artificial Sequence: Synthetic oligonucleotide
  Target: FXN; (+) strand; PAM type: YTN; PAM sequence: CTT
ttctctcagcccatcatcta

SEQ ID NO: 37376 - DNA, 20 bp, Artificial Sequence
  Description of Artificial Sequence: Synthetic oligonucleotide
  Target: FXN; (+) strand; PAM type: YTN; PAM sequence: TTT
tctctcagcccatcatctag

SEQ ID NO: 37377 - DNA, 20 bp, Artificial Sequence
  Description of Artificial Sequence: Synthetic oligonucleotide
  Target: FXN; (+) strand; PAM type: YTN; PAM sequence: TTT
ctctcagcccatcatctagc

SEQ ID NO: 37378 - DNA, 20 bp, Artificial Sequence
  Description of Artificial Sequence: Synthetic oligonucleotide
  Target: FXN; (+) strand; PAM type: YTN; PAM sequence: TTC
tctcagcccatcatctagct

SEQ ID NO: 37379 - DNA, 20 bp, Artificial Sequence
  Description of Artificial Sequence: Synthetic oligonucleotide
  Target: FXN; (+) strand; PAM type: YTN; PAM sequence: CTC
tcagcccatcatctagctac

SEQ ID NO: 37380 - DNA, 20 bp, Artificial Sequence
  Description of Artificial Sequence: Synthetic oligonucleotide
  Target: FXN; (+) strand; PAM type: YTN; PAM sequence: CTC
agcccatcatctagctacac

SEQ ID NO: 37381 - DNA, 20 bp, Artificial Sequence
  Description of Artificial Sequence: Synthetic oligonucleotide
  Target: FXN; (+) strand; PAM type: YTN; PAM sequence: CTA
gctacacagtctccagggta

SEQ ID NO: 37382 - DNA, 20 bp, Artificial Sequence
  Description of Artificial Sequence: Synthetic oligonucleotide
  Target: FXN; (+) strand; PAM type: YTN; PAM sequence: CTA
cacagtctccagggtaagct

SEQ ID NO: 37383 - DNA, 20 bp, Artificial Sequence
  Description of Artificial Sequence: Synthetic oligonucleotide
  Target: FXN; (+) strand; PAM type: YTN; PAM sequence: CTC
cagggtaagctttcagaaag

SEQ ID NO: 37384 - DNA, 20 bp, Artificial Sequence
  Description of Artificial Sequence: Synthetic oligonucleotide
  Target: FXN; (+) strand; PAM type: YTN; PAM sequence: CTT
tcagaaaggcaatctcttgt

SEQ ID NO: 37385 - DNA, 20 bp, Artificial Sequence
  Description of Artificial Sequence: Synthetic oligonucleotide
  Target: FXN; (+) strand; PAM type: YTN; PAM sequence: TTT
cagaaaggcaatctcttgtc

SEQ ID NO: 37386 - DNA, 20 bp, Artificial Sequence
  Description of Artificial Sequence: Synthetic oligonucleotide
  Target: FXN; (+) strand; PAM type: YTN; PAM sequence: TTC
agaaaggcaatctcttgtct

SEQ ID NO: 37387 - DNA, 20 bp, Artificial Sequence
  Description of Artificial Sequence: Synthetic oligonucleotide
  Target: FXN; (+) strand; PAM type: YTN; PAM sequence: CTC
ttgtctgtaaaacctaagca

SEQ ID NO: 37388 - DNA, 20 bp, Artificial Sequence
  Description of Artificial Sequence: Synthetic oligonucleotide
  Target: FXN; (+) strand; PAM type: YTN; PAM sequence: CTT
gtctgtaaaacctaagcagg

SEQ ID NO: 37389 - DNA, 20 bp, Artificial Sequence
  Description of Artificial Sequence: Synthetic oligonucleotide
  Target: FXN; (+) strand; PAM type: YTN; PAM sequence: TTG
tctgtaaaacctaagcagga

SEQ ID NO: 37390 - DNA, 20 bp, Artificial Sequence
  Description of Artificial Sequence: Synthetic oligonucleotide
  Target: FXN; (+) strand; PAM type: YTN; PAM sequence: CTG
taaaacctaagcaggaccaa

SEQ ID NO: 37391 - DNA, 20 bp, Artificial Sequence
  Description of Artificial Sequence: Synthetic oligonucleotide
  Target: FXN; (+) strand; PAM type: YTN; PAM sequence: CTA
agcaggaccaaggccaagtt

SEQ ID NO: 37392 - DNA, 20 bp, Artificial Sequence
  Description of Artificial Sequence: Synthetic oligonucleotide
  Target: FXN; (+) strand; PAM type: YTN; PAM sequence: TTT
cttagcctgaaaaatgtgct

SEQ ID NO: 37393 - DNA, 20 bp, Artificial Sequence
  Description of Artificial Sequence: Synthetic oligonucleotide
  Target: FXN; (+) strand; PAM type: YTN; PAM sequence: TTC
ttagcctgaaaaatgtgctt

SEQ ID NO: 37394 - DNA, 20 bp, Artificial Sequence
  Description of Artificial Sequence: Synthetic oligonucleotide
  Target: FXN; (+) strand; PAM type: YTN; PAM sequence: CTT
agcctgaaaaatgtgctttt

SEQ ID NO: 37395 - DNA, 20 bp, Artificial Sequence
  Description of Artificial Sequence: Synthetic oligonucleotide
  Target: FXN; (+) strand; PAM type: YTN; PAM sequence: TTA
gcctgaaaaatgtgcttttc

SEQ ID NO: 37396 - DNA, 20 bp, Artificial Sequence
  Description of Artificial Sequence: Synthetic oligonucleotide
  Target: FXN; (+) strand; PAM type: YTN; PAM sequence: CTG
aaaaatgtgcttttctgact

SEQ ID NO: 37397 - DNA, 20 bp, Artificial Sequence
  Description of Artificial Sequence: Synthetic oligonucleotide
  Target: FXN; (+) strand; PAM type: YTN; PAM sequence: CTT
ttctgactgaactgttcagg

SEQ ID NO: 37398 - DNA, 20 bp, Artificial Sequence
  Description of Artificial Sequence: Synthetic oligonucleotide
  Target: FXN; (+) strand; PAM type: YTN; PAM sequence: TTT
tctgactgaactgttcaggc

SEQ ID NO: 37399 - DNA, 20 bp, Artificial Sequence
  Description of Artificial Sequence: Synthetic oligonucleotide
  Target: FXN; (+) strand; PAM type: YTN; PAM sequence: TTT
ctgactgaactgttcaggca

SEQ ID NO: 37400 - DNA, 20 bp, Artificial Sequence
  Description of Artificial Sequence: Synthetic oligonucleotide
  Target: FXN; (+) strand; PAM type: YTN; PAM sequence: TTC
tgactgaactgttcaggcac

SEQ ID NO: 37401 - DNA, 20 bp, Artificial Sequence
  Description of Artificial Sequence: Synthetic oligonucleotide
  Target: FXN; (+) strand; PAM type: YTN; PAM sequence: CTG
actgaactgttcaggcactg

SEQ ID NO: 37402 - DNA, 20 bp, Artificial Sequence
  Description of Artificial Sequence: Synthetic oligonucleotide
  Target: FXN; (+) strand; PAM type: YTN; PAM sequence: CTG
aactgttcaggcactgactc

SEQ ID NO: 37403 - DNA, 20 bp, Artificial Sequence
  Description of Artificial Sequence: Synthetic oligonucleotide
  Target: FXN; (+) strand; PAM type: YTN; PAM sequence: CTG
ttcaggcactgactctacat

SEQ ID NO: 37404 - DNA, 20 bp, Artificial Sequence
  Description of Artificial Sequence: Synthetic oligonucleotide
  Target: FXN; (+) strand; PAM type: YTN; PAM sequence: TTC
aggcactgactctacatata

SEQ ID NO: 37405 - DNA, 20 bp, Artificial Sequence
  Description of Artificial Sequence: Synthetic oligonucleotide
  Target: FXN; (+) strand; PAM type: YTN; PAM sequence: CTG
actctacatataattatgct

SEQ ID NO: 37406 - DNA, 20 bp, Artificial Sequence
  Description of Artificial Sequence: Synthetic oligonucleotide
  Target: FXN; (+) strand; PAM type: YTN; PAM sequence: CTC
tacatataattatgcttttc

SEQ ID NO: 37407 - DNA, 20 bp, Artificial Sequence
  Description of Artificial Sequence: Synthetic oligonucleotide
  Target: FXN; (+) strand; PAM type: YTN; PAM sequence: CTA
catataattatgcttttcta

SEQ ID NO: 37408 - DNA, 20 bp, Artificial Sequence
  Description of Artificial Sequence: Synthetic oligonucleotide
  Target: FXN; (+) strand; PAM type: YTN; PAM sequence: TTA
tgcttttctaccccctcaca

SEQ ID NO: 37409 - DNA, 20 bp, Artificial Sequence
  Description of Artificial Sequence: Synthetic oligonucleotide
  Target: FXN; (+) strand; PAM type: YTN; PAM sequence: CTT
ttctaccccctcacactcaa

SEQ ID NO: 37410 - DNA, 20 bp, Artificial Sequence
  Description of Artificial Sequence: Synthetic oligonucleotide
  Target: FXN; (+) strand; PAM type: YTN; PAM sequence: TTT
tctaccccctcacactcaac

SEQ ID NO: 37411 - DNA, 20 bp, Artificial Sequence
  Description of Artificial Sequence: Synthetic oligonucleotide
  Target: FXN; (+) strand; PAM type: YTN; PAM sequence: TTT
ctaccccctcacactcaaca

SEQ ID NO: 37412 - DNA, 20 bp, Artificial Sequence
  Description of Artificial Sequence: Synthetic oligonucleotide
  Target: FXN; (+) strand; PAM type: YTN; PAM sequence: TTC
taccccctcacactcaacac

SEQ ID NO: 37413 - DNA, 20 bp, Artificial Sequence
  Description of Artificial Sequence: Synthetic oligonucleotide
  Target: FXN; (+) strand; PAM type: YTN; PAM sequence: CTA
ccccctcacactcaacactt

SEQ ID NO: 37414 - DNA, 20 bp, Artificial Sequence
  Description of Artificial Sequence: Synthetic oligonucleotide
  Target: FXN; (+) strand; PAM type: YTN; PAM sequence: CTC
acactcaacactttgactcc

SEQ ID NO: 37415 - DNA, 20 bp, Artificial Sequence
  Description of Artificial Sequence: Synthetic oligonucleotide
  Target: FXN; (+) strand; PAM type: YTN; PAM sequence: CTC
aacactttgactccagcaat

SEQ ID NO: 37416 - DNA, 20 bp, Artificial Sequence
  Description of Artificial Sequence: Synthetic oligonucleotide
  Target: FXN; (+) strand; PAM type: YTN; PAM sequence: CTT
tgactccagcaatcccaaat

SEQ ID NO: 37417 - DNA, 20 bp, Artificial Sequence
  Description of Artificial Sequence: Synthetic oligonucleotide
  Target: FXN; (+) strand; PAM type: YTN; PAM sequence: TTT
gactccagcaatcccaaatc

SEQ ID NO: 37418 - DNA, 20 bp, Artificial Sequence
  Description of Artificial Sequence: Synthetic oligonucleotide
  Target: FXN; (+) strand; PAM type: YTN; PAM sequence: TTG
actccagcaatcccaaatcc

SEQ ID NO: 37419 - DNA, 20 bp, Artificial Sequence
  Description of Artificial Sequence: Synthetic oligonucleotide
  Target: FXN; (+) strand; PAM type: YTN; PAM sequence: CTC
cagcaatcccaaatccccag

SEQ ID NO: 37420 - DNA, 20 bp, Artificial Sequence
  Description of Artificial Sequence: Synthetic oligonucleotide
  Target: FXN; (+) strand; PAM type: YTN; PAM sequence: CTA
agtgtgctgtgctattttca

SEQ ID NO: 37421 - DNA, 20 bp, Artificial Sequence
  Description of Artificial Sequence: Synthetic oligonucleotide
  Target: FXN; (+) strand; PAM type: YTN; PAM sequence: CTG
tgctattttcacgtggctct

SEQ ID NO: 37422 - DNA, 20 bp, Artificial Sequence
  Description of Artificial Sequence: Synthetic oligonucleotide
  Target: FXN; (+) strand; PAM type: YTN; PAM sequence: CTA
ttttcacgtggctctcagac

SEQ ID NO: 37423 - DNA, 20 bp, Artificial Sequence
  Description of Artificial Sequence: Synthetic oligonucleotide
  Target: FXN; (+) strand; PAM type: YTN; PAM sequence: TTT
tcacgtggctctcagacttg

SEQ ID NO: 37424 - DNA, 20 bp, Artificial Sequence
  Description of Artificial Sequence: Synthetic oligonucleotide
  Target: FXN; (+) strand; PAM type: YTN; PAM sequence: TTT
cacgtggctctcagacttgg

SEQ ID NO: 37425 - DNA, 20 bp, Artificial Sequence
  Description of Artificial Sequence: Synthetic oligonucleotide
  Target: FXN; (+) strand; PAM type: YTN; PAM sequence: TTC
acgtggctctcagacttggc

SEQ ID NO: 37426 - DNA, 20 bp, Artificial Sequence
  Description of Artificial Sequence: Synthetic oligonucleotide
  Target: FXN; (+) strand; PAM type: YTN; PAM sequence: CTC
tcagacttggccagtgctgt

SEQ ID NO: 37427 - DNA, 20 bp, Artificial Sequence
  Description of Artificial Sequence: Synthetic oligonucleotide
  Target: FXN; (+) strand; PAM type: YTN; PAM sequence: CTC
agacttggccagtgctgttt

SEQ ID NO: 37428 - DNA, 20 bp, Artificial Sequence
  Description of Artificial Sequence: Synthetic oligonucleotide
  Target: FXN; (+) strand; PAM type: YTN; PAM sequence: CTT
ggccagtgctgtttccattt

SEQ ID NO: 37429 - DNA, 20 bp, Artificial Sequence
  Description of Artificial Sequence: Synthetic oligonucleotide
  Target: FXN; (+) strand; PAM type: YTN; PAM sequence: TTG
gccagtgctgtttccatttt

SEQ ID NO: 37430 - DNA, 20 bp, Artificial Sequence
  Description of Artificial Sequence: Synthetic oligonucleotide
  Target: FXN; (+) strand; PAM type: YTN; PAM sequence: CTG
tttccattttggtctttatt

SEQ ID NO: 37431 - DNA, 20 bp, Artificial Sequence
  Description of Artificial Sequence: Synthetic oligonucleotide
  Target: FXN; (+) strand; PAM type: YTN; PAM sequence: TTT
ccattttggtctttattccc

SEQ ID NO: 37432 - DNA, 20 bp, Artificial Sequence
  Description of Artificial Sequence: Synthetic oligonucleotide
  Target: FXN; (+) strand; PAM type: YTN; PAM sequence: TTC
cattttggtctttattcccc

SEQ ID NO: 37433 - DNA, 20 bp, Artificial Sequence
  Description of Artificial Sequence: Synthetic oligonucleotide
  Target: FXN; (+) strand; PAM type: YTN; PAM sequence: TTT
tggtctttattccccacatc

SEQ ID NO: 37434 - DNA, 20 bp, Artificial Sequence
  Description of Artificial Sequence: Synthetic oligonucleotide
  Target: FXN; (+) strand; PAM type: YTN; PAM sequence: TTT
ggtctttattccccacatct

SEQ ID NO: 37435 - DNA, 20 bp, Artificial Sequence
  Description of Artificial Sequence: Synthetic oligonucleotide
  Target: FXN; (+) strand; PAM type: YTN; PAM sequence: TTG
gtctttattccccacatctc

SEQ ID NO: 37436 - DNA, 20 bp, Artificial Sequence
  Description of Artificial Sequence: Synthetic oligonucleotide
  Target: FXN; (+) strand; PAM type: YTN; PAM sequence: CTT
tattccccacatctctgcct

SEQ ID NO: 37437 - DNA, 20 bp, Artificial Sequence
  Description of Artificial Sequence: Synthetic oligonucleotide
  Target: FXN; (+) strand; PAM type: YTN; PAM sequence: TTT
attccccacatctctgcctg

SEQ ID NO: 37438 - DNA, 20 bp, Artificial Sequence
  Description of Artificial Sequence: Synthetic oligonucleotide
  Target: FXN; (+) strand; PAM type: YTN; PAM sequence: TTA
ttccccacatctctgcctgg

SEQ ID NO: 37439 - DNA, 20 bp, Artificial Sequence
  Description of Artificial Sequence: Synthetic oligonucleotide
  Target: FXN; (+) strand; PAM type: YTN; PAM sequence: TTC
cccacatctctgcctggggg

SEQ ID NO: 37440 - DNA, 20 bp, Artificial Sequence
  Description of Artificial Sequence: Synthetic oligonucleotide
  Target: FXN; (+) strand; PAM type: YTN; PAM sequence: CTC
tgcctggggggtagattcta

SEQ ID NO: 37441 - DNA, 20 bp, Artificial Sequence
  Description of Artificial Sequence: Synthetic oligonucleotide
  Target: FXN; (+) strand; PAM type: YTN; PAM sequence: CTG
cctggggggtagattctacc

SEQ ID NO: 37442 - DNA, 20 bp, Artificial Sequence
  Description of Artificial Sequence: Synthetic oligonucleotide
  Target: FXN; (+) strand; PAM type: YTN; PAM sequence: CTG
gggggtagattctaccctga

SEQ ID NO: 37443 - DNA, 20 bp, Artificial Sequence
  Description of Artificial Sequence: Synthetic oligonucleotide
  Target: FXN; (+) strand; PAM type: YTN; PAM sequence: TTC
taccctgaaaaatgttcttg

SEQ ID NO: 37444 - DNA, 20 bp, Artificial Sequence
  Description of Artificial Sequence: Synthetic oligonucleotide
  Target: FXN; (+) strand; PAM type: YTN; PAM sequence: CTA
ccctgaaaaatgttcttggc

SEQ ID NO: 37445 - DNA, 20 bp, Artificial Sequence
  Description of Artificial Sequence: Synthetic oligonucleotide
  Target: FXN; (+) strand; PAM type: YTN; PAM sequence: CTG
aaaaatgttcttggcacagc

SEQ ID NO: 37446 - DNA, 20 bp, Artificial Sequence
  Description of Artificial Sequence: Synthetic oligonucleotide
  Target: FXN; (+) strand; PAM type: YTN; PAM sequence: TTC
ttggcacagccttgcaaact

SEQ ID NO: 37447 - DNA, 20 bp, Artificial Sequence
  Description of Artificial Sequence: Synthetic oligonucleotide
  Target: FXN; (+) strand; PAM type: YTN; PAM sequence: CTT
ggcacagccttgcaaactcc

SEQ ID NO: 37448 - DNA, 20 bp, Artificial Sequence
  Description of Artificial Sequence: Synthetic oligonucleotide
  Target: FXN; (+) strand; PAM type: YTN; PAM sequence: TTG
gcacagccttgcaaactcct

SEQ ID NO: 37449 - DNA, 20 bp, Artificial Sequence
  Description of Artificial Sequence: Synthetic oligonucleotide
  Target: FXN; (+) strand; PAM type: YTN; PAM sequence: CTT
gcaaactcctcctccactca

SEQ ID NO: 37450 - DNA, 20 bp, Artificial Sequence
  Description of Artificial Sequence: Synthetic oligonucleotide
  Target: FXN; (+) strand; PAM type: YTN; PAM sequence: TTG
caaactcctcctccactcag

SEQ ID NO: 37451 - DNA, 20 bp, Artificial Sequence
  Description of Artificial Sequence: Synthetic oligonucleotide
  Target: FXN; (+) strand; PAM type: YTN; PAM sequence: CTC
ctcctccactcagcctctgc

SEQ ID NO: 37452 - DNA, 20 bp, Artificial Sequence
  Description of Artificial Sequence: Synthetic oligonucleotide
  Target: FXN; (+) strand; PAM type: YTN; PAM sequence: CTC
ctccactcagcctctgcctg

SEQ ID NO: 37453 - DNA, 20 bp, Artificial Sequence
  Description of Artificial Sequence: Synthetic oligonucleotide
  Target: FXN; (+) strand; PAM type: YTN; PAM sequence: CTC
cactcagcctctgcctggat

SEQ ID NO: 37454 - DNA, 20 bp, Artificial Sequence
  Description of Artificial Sequence: Synthetic oligonucleotide
  Target: FXN; (+) strand; PAM type: YTN; PAM sequence: CTC
agcctctgcctggatgccct

SEQ ID NO: 37455 - DNA, 20 bp, Artificial Sequence
  Description of Artificial Sequence: Synthetic oligonucleotide
  Target: FXN; (+) strand; PAM type: YTN; PAM sequence: CTC
tgcctggatgcccttgattg

SEQ ID NO: 37456 - DNA, 20 bp, Artificial Sequence
  Description of Artificial Sequence: Synthetic oligonucleotide
  Target: FXN; (+) strand; PAM type: YTN; PAM sequence: CTG
cctggatgcccttgattgtt

SEQ ID NO: 37457 - DNA, 20 bp, Artificial Sequence
  Description of Artificial Sequence: Synthetic oligonucleotide
  Target: FXN; (+) strand; PAM type: YTN; PAM sequence: CTG
gatgcccttgattgttccat

SEQ ID NO: 37458 - DNA, 20 bp, Artificial Sequence
  Description of Artificial Sequence: Synthetic oligonucleotide
  Target: FXN; (+) strand; PAM type: YTN; PAM sequence: CTT
gattgttccatgtcctcagc

SEQ ID NO: 37459 - DNA, 20 bp, Artificial Sequence
  Description of Artificial Sequence: Synthetic oligonucleotide
  Target: FXN; (+) strand; PAM type: YTN; PAM sequence: TTG
attgttccatgtcctcagca

SEQ ID NO: 37460 - DNA, 20 bp, Artificial Sequence
  Description of Artificial Sequence: Synthetic oligonucleotide
  Target: FXN; (+) strand; PAM type: YTN; PAM sequence: TTG
ttccatgtcctcagcatacc

SEQ ID NO: 37461 - DNA, 20 bp, Artificial Sequence
  Description of Artificial Sequence: Synthetic oligonucleotide
  Target: FXN; (+) strand; PAM type: YTN; PAM sequence: TTC
catgtcctcagcataccatg

SEQ ID NO: 37462 - DNA, 20 bp, Artificial Sequence
  Description of Artificial Sequence: Synthetic oligonucleotide
  Target: FXN; (+) strand; PAM type: YTN; PAM sequence: CTC
agcataccatgtttgtcttt

SEQ ID NO: 37463 - DNA, 20 bp, Artificial Sequence
  Description of Artificial Sequence: Synthetic oligonucleotide
  Target: FXN; (+) strand; PAM type: YTN; PAM sequence: TTT
gtctttcccagcactgacct

SEQ ID NO: 37464 - DNA, 20 bp, Artificial Sequence
  Description of Artificial Sequence: Synthetic oligonucleotide
  Target: FXN; (+) strand; PAM type: YTN; PAM sequence: TTG
tctttcccagcactgaccta

SEQ ID NO: 37465 - DNA, 20 bp, Artificial Sequence
  Description of Artificial Sequence: Synthetic oligonucleotide
  Target: FXN; (+) strand; PAM type: YTN; PAM sequence: CTT
tcccagcactgacctaccat

SEQ ID NO: 37466 - DNA, 20 bp, Artificial Sequence
  Description of Artificial Sequence: Synthetic oligonucleotide
  Target: FXN; (+) strand; PAM type: YTN; PAM sequence: TTT
cccagcactgacctaccatg

SEQ ID NO: 37467 - DNA, 20 bp, Artificial Sequence
  Description of Artificial Sequence: Synthetic oligonucleotide
  Target: FXN; (+) strand; PAM type: YTN; PAM sequence: TTC
ccagcactgacctaccatgt

SEQ ID NO: 37468 - DNA, 20 bp, Artificial Sequence
  Description of Artificial Sequence: Synthetic oligonucleotide
  Target: FXN; (+) strand; PAM type: YTN; PAM sequence: CTG
acctaccatgtgtcacccct

SEQ ID NO: 37469 - DNA, 20 bp, Artificial Sequence
  Description of Artificial Sequence: Synthetic oligonucleotide
  Target: FXN; (+) strand; PAM type: YTN; PAM sequence: CTA
ccatgtgtcacccctgcttg

SEQ ID NO: 37470 - DNA, 20 bp, Artificial Sequence
  Description of Artificial Sequence: Synthetic oligonucleotide
  Target: FXN; (+) strand; PAM type: YTN; PAM sequence: CTG
cttggctgtaccttccatga

SEQ ID NO: 37471 - DNA, 20 bp, Artificial Sequence
  Description of Artificial Sequence: Synthetic oligonucleotide
  Target: FXN; (+) strand; PAM type: YTN; PAM sequence: CTT
ggctgtaccttccatgaggc

SEQ ID NO: 37472 - DNA, 20 bp, Artificial Sequence
  Description of Artificial Sequence: Synthetic oligonucleotide
  Target: FXN; (+) strand; PAM type: YTN; PAM sequence: TTG
gctgtaccttccatgaggct

SEQ ID NO: 37473 - DNA, 20 bp, Artificial Sequence
  Description of Artificial Sequence: Synthetic oligonucleotide
  Target: FXN; (+) strand; PAM type: YTN; PAM sequence: CTG
taccttccatgaggctagga

SEQ ID NO: 37474 - DNA, 20 bp, Artificial Sequence
  Description of Artificial Sequence: Synthetic oligonucleotide
  Target: FXN; (+) strand; PAM type: YTN; PAM sequence: CTT
ccatgaggctaggactatgt

SEQ ID NO: 37475 - DNA, 20 bp, Artificial Sequence
  Description of Artificial Sequence: Synthetic oligonucleotide
  Target: FXN; (+) strand; PAM type: YTN; PAM sequence: TTC
catgaggctaggactatgtg

SEQ ID NO: 37476 - DNA, 20 bp, Artificial Sequence
  Description of Artificial Sequence: Synthetic oligonucleotide
  Target: FXN; (+) strand; PAM type: YTN; PAM sequence: CTA
ggactatgtgtctcctttgt

SEQ ID NO: 37477 - DNA, 20 bp, Artificial Sequence
  Description of Artificial Sequence: Synthetic oligonucleotide
  Target: FXN; (+) strand; PAM type: YTN; PAM sequence: CTA
tgtgtctcctttgttgactg

SEQ ID NO: 37478 - DNA, 20 bp, Artificial Sequence
  Description of Artificial Sequence: Synthetic oligonucleotide
  Target: FXN; (+) strand; PAM type: YTN; PAM sequence: CTC
ctttgttgactgctgttgcc

SEQ ID NO: 37479 - DNA, 20 bp, Artificial Sequence
  Description of Artificial Sequence: Synthetic oligonucleotide
  Target: FXN; (+) strand; PAM type: YTN; PAM sequence: CTT
tgttgactgctgttgcccta

SEQ ID NO: 37480 - DNA, 20 bp, Artificial Sequence
  Description of Artificial Sequence: Synthetic oligonucleotide
  Target: FXN; (+) strand; PAM type: YTN; PAM sequence: TTT
gttgactgctgttgccctag

SEQ ID NO: 37481 - DNA, 20 bp, Artificial Sequence
  Description of Artificial Sequence: Synthetic oligonucleotide
  Target: FXN; (+) strand; PAM type: YTN; PAM sequence: TTG
ttgactgctgttgccctagc

SEQ ID NO: 37482 - DNA, 20 bp, Artificial Sequence
  Description of Artificial Sequence: Synthetic oligonucleotide
  Target: FXN; (+) strand; PAM type: YTN; PAM sequence: TTG
actgctgttgccctagcatc

SEQ ID NO: 37483 - DNA, 20 bp, Artificial Sequence
  Description of Artificial Sequence: Synthetic oligonucleotide
  Target: FXN; (+) strand; PAM type: YTN; PAM sequence: CTG
ctgttgccctagcatcttgc

SEQ ID NO: 37484 - DNA, 20 bp, Artificial Sequence
  Description of Artificial Sequence: Synthetic oligonucleotide
  Target: FXN; (+) strand; PAM type: YTN; PAM sequence: CTG
ttgccctagcatcttgcaca

SEQ ID NO: 37485 - DNA, 20 bp, Artificial Sequence
  Description of Artificial Sequence: Synthetic oligonucleotide
  Target: FXN; (+) strand; PAM type: YTN; PAM sequence: TTG
ccctagcatcttgcacagtt

SEQ ID NO: 37486 - DNA, 20 bp, Artificial Sequence
  Description of Artificial Sequence: Synthetic oligonucleotide
  Target: FXN; (+) strand; PAM type: YTN; PAM sequence: CTA
gcatcttgcacagttccttg

SEQ ID NO: 37487 - DNA, 20 bp, Artificial Sequence
  Description of Artificial Sequence: Synthetic oligonucleotide
  Target: FXN; (+) strand; PAM type: YTN; PAM sequence: CTT
gcacagttccttgcacacaa

SEQ ID NO: 37488 - DNA, 20 bp, Artificial Sequence
  Description of Artificial Sequence: Synthetic oligonucleotide
  Target: FXN; (+) strand; PAM type: YTN; PAM sequence: TTG
cacagttccttgcacacaat

SEQ ID NO: 37489 - DNA, 20 bp, Artificial Sequence
  Description of Artificial Sequence: Synthetic oligonucleotide
  Target: FXN; (+) strand; PAM type: YTN; PAM sequence: TTC
cttgcacacaattagagctc

SEQ ID NO: 37490 - DNA, 20 bp, Artificial Sequence
  Description of Artificial Sequence: Synthetic oligonucleotide
  Target: FXN; (+) strand; PAM type: YTN; PAM sequence: CTT
gcacacaattagagctctat

SEQ ID NO: 37491 - DNA, 20 bp, Artificial Sequence
  Description of Artificial Sequence: Synthetic oligonucleotide
  Target: FXN; (+) strand; PAM type: YTN; PAM sequence: TTG
cacacaattagagctctata

SEQ ID NO: 37492 - DNA, 20 bp, Artificial Sequence
  Description of Artificial Sequence: Synthetic oligonucleotide
  Target: FXN; (+) strand; PAM type: YTN; PAM sequence: TTA
gagctctataaatgtcaaat

SEQ ID NO: 37493 - DNA, 20 bp, Artificial Sequence
  Description of Artificial Sequence: Synthetic oligonucleotide
  Target: FXN; (+) strand; PAM type: YTN; PAM sequence: CTC
tataaatgtcaaataaatgt

SEQ ID NO: 37494 - DNA, 20 bp, Artificial Sequence
  Description of Artificial Sequence: Synthetic oligonucleotide
  Target: FXN; (+) strand; PAM type: YTN; PAM sequence: CTA
taaatgtcaaataaatgtgt

SEQ ID NO: 37495 - DNA, 20 bp, Artificial Sequence
  Description of Artificial Sequence: Synthetic oligonucleotide
  Target: FXN; (+) strand; PAM type: YTN; PAM sequence: TTA
taattatatgtttaagatag

SEQ ID NO: 37496 - DNA, 20 bp, Artificial Sequence
  Description of Artificial Sequence: Synthetic oligonucleotide
  Target: FXN; (+) strand; PAM type: YTN; PAM sequence: TTA
tatgtttaagatagttgttc

SEQ ID NO: 37497 - DNA, 20 bp, Artificial Sequence
  Description of Artificial Sequence: Synthetic oligonucleotide
  Target: FXN; (+) strand; PAM type: YTN; PAM sequence: TTT
aagatagttgttcaaataaa

SEQ ID NO: 37498 - DNA, 20 bp, Artificial Sequence
  Description of Artificial Sequence: Synthetic oligonucleotide
  Target: FXN; (+) strand; PAM type: YTN; PAM sequence: TTA
agatagttgttcaaataaac

SEQ ID NO: 37499 - DNA, 20 bp, Artificial Sequence
  Description of Artificial Sequence: Synthetic oligonucleotide
  Target: FXN; (+) strand; PAM type: YTN; PAM sequence: TTG
ttcaaataaactctaaataa

SEQ ID NO: 37500 - DNA, 20 bp, Artificial Sequence
  Description of Artificial Sequence: Synthetic oligonucleotide
  Target: FXN; (+) strand; PAM type: YTN; PAM sequence: TTC
aaataaactctaaataaccc

SEQ ID NO: 37501 - DNA, 20 bp, Artificial Sequence
  Description of Artificial Sequence: Synthetic oligonucleotide
  Target: FXN; (+) strand; PAM type: YTN; PAM sequence: CTC
taaataaccccaactccaag

SEQ ID NO: 37502 - DNA, 20 bp, Artificial Sequence
  Description of Artificial Sequence: Synthetic oligonucleotide
  Target: FXN; (+) strand; PAM type: YTN; PAM sequence: CTA
aataaccccaactccaagag

SEQ ID NO: 37503 - DNA, 20 bp, Artificial Sequence
  Description of Artificial Sequence: Synthetic oligonucleotide
  Target: FXN; (+) strand; PAM type: YTN; PAM sequence: CTC
caagagtgttagcaagaaat

SEQ ID NO: 37504 - DNA, 20 bp, Artificial Sequence
  Description of Artificial Sequence: Synthetic oligonucleotide
  Target: FXN; (+) strand; PAM type: YTN; PAM sequence: TTA
gcaagaaatataaattttac

SEQ ID NO: 37505 - DNA, 20 bp, Artificial Sequence
  Description of Artificial Sequence: Synthetic oligonucleotide
  Target: FXN; (+) strand; PAM type: YTN; PAM sequence: TTT
tacagaagaatggttggagg

SEQ ID NO: 37506 - DNA, 20 bp, Artificial Sequence
  Description of Artificial Sequence: Synthetic oligonucleotide
  Target: FXN; (+) strand; PAM type: YTN; PAM sequence: TTT
acagaagaatggttggaggt

SEQ ID NO: 37507 - DNA, 20 bp, Artificial Sequence
  Description of Artificial Sequence: Synthetic oligonucleotide
  Target: FXN; (+) strand; PAM type: YTN; PAM sequence: TTA
cagaagaatggttggaggtg

SEQ ID NO: 37508 - DNA, 20 bp, Artificial Sequence
  Description of Artificial Sequence: Synthetic oligonucleotide
  Target: FXN; (+) strand; PAM type: YTN; PAM sequence: TTG
gaggtggggagggtgtccac

SEQ ID NO: 37509 - DNA, 20 bp, Artificial Sequence
  Description of Artificial Sequence: Synthetic oligonucleotide
  Target: FXN; (+) strand; PAM type: YTN; PAM sequence: TTA
cctcacacaggcacggaaaa

SEQ ID NO: 37510 - DNA, 20 bp, Artificial Sequence
  Description of Artificial Sequence: Synthetic oligonucleotide
  Target: FXN; (+) strand; PAM type: YTN; PAM sequence: CTC
acacaggcacggaaaaactt

SEQ ID NO: 37511 - DNA, 20 bp, Artificial Sequence
  Description of Artificial Sequence: Synthetic oligonucleotide
  Target: FXN; (+) strand; PAM type: YTN; PAM sequence: CTT
gaacctcctaaggacatttt

SEQ ID NO: 37512 - DNA, 20 bp, Artificial Sequence
  Description of Artificial Sequence: Synthetic oligonucleotide
  Target: FXN; (+) strand; PAM type: YTN; PAM sequence: TTG
aacctcctaaggacattttt

SEQ ID NO: 37513 - DNA, 20 bp, Artificial Sequence
  Description of Artificial Sequence: Synthetic oligonucleotide
  Target: FXN; (+) strand; PAM type: YTN; PAM sequence: CTC
ctaaggacatttttaagctc

SEQ ID NO: 37514 - DNA, 20 bp, Artificial Sequence
  Description of Artificial Sequence: Synthetic oligonucleotide
  Target: FXN; (+) strand; PAM type: YTN; PAM sequence: CTA
aggacatttttaagctctct

SEQ ID NO: 37515-37544 - skipped (30 entries)

SEQ ID NO: 37545 - DNA, 23 bp, Artificial Sequence
  Description of Artificial Sequence: Synthetic oligonucleotide
  modified_base (1)..(21): a, c, t, g, unknown or other
nnnnnnnnnnnnnnnnnnnnnrg

SEQ ID NO: 37546 - RNA, 100 nt, Artificial Sequence
  chemically synthesized
  modified_base (1)..(20): n is a, c, g, u, or other
nnnnnnnnnnnnnnnnnnnnguuuuagagcuagaaauagcaaguuaaaauaaggcuaguccguuaucaacuugaaaaaguggcaccgagucggugcuuuu

SEQ ID NO: 37547 - RNA, 96 nt, Artificial Sequence
  chemically synthesized
  modified_base (1)..(20): n is a, c, g, u, or other
nnnnnnnnnnnnnnnnnnnnguuuuagagcuagaaauagcaaguuaaaauaaggcuaguccguuaucaacuugaaaaaguggcaccgagucggugc

SEQ ID NO: 37548 - RNA, 114 nt, Artificial Sequence
  chemically synthesized
  modified_base (1)..(30): n is a, c, g, u, or other and this region may encompass 17-30 nucleotides;
  modified_base (107)..(114): This region may encompass 1-8 urasil;
nnnnnnnnnnnnnnnnnnnnnnnnnnnnnnguuuuagagcuagaaauagcaaguuaaaauaaggcuaguccguuaucaacuugaaaaaguggcaccgagucggugcuuuuuuuu

SEQ ID NO: 37549 - DNA, 20 bp, Artificial Sequence
  Description of Artificial Sequence: Synthetic oligonucleotide
  Target: FXN; (-) strand; PAM type: NRG; PAM sequence: AGG
gggccgggctgggtgacgcc
